US012503707B2

(12) United States Patent
Albinsky et al.

(10) Patent No.: US 12,503,707 B2
(45) Date of Patent: Dec. 23, 2025

(54) METHODS, PLANTS AND COMPOSITIONS FOR OVERCOMING NUTRIENT SUPPRESSION OF MYCORRHIZAL SYMBIOSIS

(71) Applicant: Cambridge Enterprise Limited, Cambridge (GB)

(72) Inventors: Doris Albinsky, Cambridge (GB); Xinran Li, Cambridge (GB); Giles Edward Dixon Oldroyd, Cambridge (GB); Jongho Sun, Cambridge (GB)

(73) Assignee: CAMBRIDGE ENTERPRISE LIMITED, Cambridge (GB)

( * ) Notice: Subject to any disclaimer, the term of this patent is extended or adjusted under 35 U.S.C. 154(b) by 174 days.

(21) Appl. No.: 17/802,506

(22) PCT Filed: Feb. 26, 2021

(86) PCT No.: PCT/EP2021/054816
§ 371 (c)(1),
(2) Date: Aug. 25, 2022

(87) PCT Pub. No.: WO2021/170794
PCT Pub. Date: Sep. 2, 2021

(65) Prior Publication Data

US 2024/0229060 A1 Jul. 11, 2024

Related U.S. Application Data

(60) Provisional application No. 62/983,433, filed on Feb. 28, 2020.

(51) Int. Cl.
*C12N 15/82* (2006.01)
*C07K 2/00* (2006.01)

(52) U.S. Cl.
CPC ............ *C12N 15/8261* (2013.01); *C07K 2/00* (2013.01)

(58) Field of Classification Search
None
See application file for complete search history.

(56) References Cited

U.S. PATENT DOCUMENTS

| | | | |
|---|---|---|---|
| 4,407,956 | A | 10/1983 | Howell |
| 4,536,475 | A | 8/1985 | Anderson |
| 4,683,195 | A | 7/1987 | Mullis et al. |
| 4,683,202 | A | 7/1987 | Mullis |
| 4,684,611 | A | 8/1987 | Schilperoort et al. |
| 4,800,159 | A | 1/1989 | Mullis et al. |
| 5,679,558 | A | 10/1997 | Gobel et al. |
| 6,140,553 | A | 10/2000 | D'Halluin |

FOREIGN PATENT DOCUMENTS

| | | | |
|---|---|---|---|
| EP | 67553 | A2 | 12/1982 |
| EP | 116718 | B2 | 8/1984 |
| EP | 233247 | A2 | 11/1986 |
| EP | 270356 | B1 | 6/1988 |
| EP | 270822 | A1 | 6/1988 |
| EP | 242246 | B1 | 11/1992 |
| WO | WO-1984002913 | A1 | 8/1984 |
| WO | WO-1985001856 | A1 | 5/1985 |
| WO | WO-1992009696 | A1 | 6/1992 |
| WO | WO-1996006932 | A1 | 3/1996 |
| WO | WO-1997048819 | A1 | 12/1997 |
| WO | WO-2000042207 | A2 | 7/2000 |
| WO | WO-2000071733 | A1 | 11/2000 |
| WO | WO-2009073069 | A2 | 6/2009 |
| WO | WO-2015071749 | A1 | 5/2015 |
| WO | WO-2015185862 | A1 | 12/2015 |
| WO | WO 2018236792 | * | 12/2018 |

OTHER PUBLICATIONS

Belzeque et al .Journal of Exp. Bot (2011) 62: 1049-1060.*
Li et al., (2022). "Nutrient regulation of lipochitooligosaccharide recognition in plants via NSP1 and NSP2," Nature Communications, 13:6421, 32 pages.
Altschul et al., (1997). "Gapped BLAST and PSI-BLAST: a new generation of protein database search programs," Nucleic acids research, 25(17):3389-3402.
Altschul et al., (1990). "Basic local alignment search tool," J. Mol. Biol., 215:403-410.
An et al., (1996). "Strong, constitutive expression of the *Arabidopsis* ACT2/ACT8 actin subclass in vegetative tissues," The Plant Journal, 10(1):107-121.
Balzergue et al., (2013). "High phosphate reduces host ability to develop arbuscular mycorrhizal symbiosis without affecting root calcium spiking responses to the fungus," Frontiers in plant science, 4:426, 15 pages.
Bartlett et al., (2009). "Intron-mediated enhancement as a method for increasing transgene expression levels in barley," Plant Biotechnol. J., 7:856-866.
Bozsoki et al., (2017). "Receptor-mediated chitin perception in legume roots is functionally separable from Nod factor perception," PNAS, 114(38):E8118-E8127.

(Continued)

*Primary Examiner* — Medina A Ibrahim
(74) *Attorney, Agent, or Firm* — Morrison & Foerster LLP

(57) ABSTRACT

Aspects of the present disclosure relate to methods of cultivating genetically altered plants with increased activity of one or more of a NODULATION SIGNALING PATHWAY 1 (NSP1) protein or a NODULATION SIGNALING PATHWAY 2 (NSP2) protein that have increased mycorrhization and/or promoted symbiotic responses under high phosphate and/or high nitrate conditions. Further aspects of the present disclosure relate to methods of cultivating genetically altered plants with increased activity of a C-TERMINALLY ENCODED PEPTIDE (CEP peptide) that have increased mycorrhization and/or promoted symbiotic responses under high phosphate and/or high nitrate conditions. In addition, aspects of the present disclosure relate to methods of cultivating these plants that include exogenous application of strigolactones, karrikins, and/or CEP peptides to increase mycorrhization and/or promote symbiotic responses under specific nutrient conditions.

9 Claims, 85 Drawing Sheets

Specification includes a Sequence Listing.

(56) References Cited

OTHER PUBLICATIONS

Christensen et al., (1992). "Maize polyubiquitin genes: structure, thermal perturbation of expression and transcript splicing, and promoter activity following transfer to protoplasts by electroporation," Plant molecular biology, 18(4):675-689.
Christou et al., (1990). "Soybean genetic engineering-commercial production of transgenic plants," Trends in Biotechnology, 8:145-151.
Datta et al., (1990). "Genetically engineered fertile indica-rice recovered from protoplasts," Bio/technology, 8(8):736-740.
de Pater et al., (1992). "The promoter of the rice gene GOS2 is active in various different monocot tissues and binds rice nuclear factor ASF-1," The Plant Journal, 2(6):837-844.
Delaux et al., (2013). "NSP1 is a component of the Myc signaling pathway," New Phytologist, 199:59-65.
Depicker et al., (1982). "Nopaline synthase: transcript mapping and DNA sequence," Journal of molecular and applied genetics, 1(6):561-573.
Feike et al., (2019). "Characterizing standard genetic parts and establishing common principles for engineering legume and cereal roots," Plant Biotechnology Journal, 17(12):2234-2245.
Feng et al., (2019). "A combination of chitooligosaccharide and lipochitooligosaccharide recognition promotes arbuscular mycorrhizal associations in Medicago truncatula," Nature Comms, 10:5047, 12 pages.
Foley et al., (2011). "Solutions for a cultivated planet," Nature, 478:337-342, 6 pages.
Franck et al., (1980). "Nucleotide sequence of cauliflower mosaic virus DNA," Cell, 21(1):285-294.
Fromm et al., (1990). "Inheritance and expression of chimeric genes in the progeny of transgenic maize plants," Bio/technology, 8(9):833-839.
Gardner et al., (1981). "The complete nucleotide sequence of an infectious clone of cauliflower mosaic virus by M13mp7 shotgun sequencing," Nucleic acids research, 9(12):2871-2888.
Gielen et al., (1984). "The complete nucleotide sequence of the TL-DNA of the Agrobacterium tumefaciens plasmid pTiAch5," The EMBO Journal, 3(4):835-846.
Giovanetti et al., (1980). "An Evaluation Of Techniques For Measuring Vesicular Arbuscular Mycorrhizal Infection In Roots," New Phytol., 84:489-500.
Gordon-Kamm et al., (1990). "Transformation of Maize Cells and Regeneration of Fertile Transgenic Plants," The Plant cell, 2(7):603-618.
Herrmann et al., (2007). "Nano-scale secondary ion mass spectrometry—A new analytical tool in biogeochemistry and soil ecology: A review article," Soil Biol Biochem, 39(8):1835-1850, 52 pages.
Hill et al., (2011). "Acquisition and assimilation of nitrogen as peptide-bound and D-enantiomers of amino acids by wheat," PLoS One, 6(4):e19220, 4 pages.
Hinchee et al., (1988). "Production of transgenic soybean plants using Agrobacterium-mediated DNA transfer," Bio/technology, 6.8:915-922.
Hull et al., (1978). "Structure of the cauliflower mosaic virus genome. II. Variation in DNA structure and sequence between isolates," Virology, 86(2):482-493.
International Search Report and Written Opinion received for International Patent Application No. PCT/EP2021/054816 mailed on Jul. 30, 2021, 23 pages.
Jones et al., (2005). "Plant capture of free amino acids is maximized under high soil amino acid concentrations," Soil Biol Biochem, 37:179-181.
Jones et al., (2013). "Competition between plant and bacterial cells at the microscale regulates the dynamics of nitrogen acquisition in wheat (*Triticum aestivum*)," New Phytol., 200(3):796-807.
Kaló et al., (2005). "Nodulation Signaling in Legumes Requires NSP2, a Member of the GRAS Family of Transcriptional Regulators," Science, 308:1786-1789.
Karlin et al., (1990). "Methods for assessing the statistical significance of molecular sequence features by using general scoring schemes," PNAS, 87(6):2264-2268.
Karlin et al., (1993). "Applications and statistics for multiple high-scoring segments in molecular sequences," PNAS, 90(12):5873-5877.
Kay et al., (1987). "Duplication of CaMV 35S Promoter Sequences Creates a Strong Enhancer for Plant Genes," Science, 236(4806):1299-1302.
Kereszt et al., (2018). "Impact of Plant Peptides on Symbiotic Nodule Development and Functioning," Frontiers in plant science, 9:1026, 16 pages.
Kielland, (1994). "Amino acid absorption by arctic plants: implications for plant nutrition and nitrogen cycling," Ecology, 75:2373-2383.
Last et al., (1991). "pEmu: an improved promoter for gene expression in cereal cells." TAG. Theoretical and applied genetics, 81(5):581-588.
Lauressergues et al., (2012). "The microRNA miR171h modulates arbuscular mycorrhizal colonization of Medicago truncatula by targeting NSP2," The Plant Journal, 72(3):512-522.
Lee et al., (2007). "Novel Plant Transformation Vectors Containing the Superpromoter," Plant Physiol., 145:1294-1300.
Limpens et al., (2003). "LysM domain receptor kinases regulating rhizobial Nod factor-induced infection," Science, 302:630-633.
Liu et al., (2011). "Strigolactone Biosynthesis in Medicago truncatula and Rice Requires the Symbiotic GRAS-Type Transcription Factors NSP1 and NSP2," Plant Cell, 23:3853-3865.
Luginbuehl et al., (2017). "Fatty acids in arbuscular mycorrhizal fungi are synthesized by the host plant," Science, 356:1175-1178, 3 pages.
Mohd-Radzman et al., (2016). "Different Pathways Act Downstream of the CEP Peptide Receptor CRA2 to Regulate Lateral Root and Nodule Development," Plant Physiology, 171(4):2536-2548.
Näsholm et al., (2009). "Uptake of organic nitrogen by plants," New Phytologist, 182:31-48.
Nelson et al., (2010). "Karrikins enhance light responses during germination and seedling development in *Arabidopsis thaliana*," PNAS, 107(15):7095-7100.
Norris et al., (1993). "The intron of *Arabidopsis thaliana* polyubiquitin genes is conserved in location and is a quantitative determinant of chimeric gene expression," Plant molecular biology, 21(5):895-906.
Oldroyd, (2013). "Speak, friend, and enter: signalling systems that promote beneficial symbiotic associations in plants," Nature Reviews Microbiology, 11:252-263, 24 pages.
Parniske, (2008). "Arbuscular mycorrhiza: the mother of plant root endosymbioses," Nature Reviews Microbiology, 6:763-775, 25 pages.
Rockström et al., (2009). "A safe operating space for humanity," Nature, 461:472-475.
Saiki et al., (1985). "Enzymatic amplification of beta-globin genomic sequences and restriction site analysis for diagnosis of sickle cell anemia," Science, 230(4732):1350-1354.
Schünmann et al., (2003). "A suite of novel promoters and terminators for plant biotechnology. II. The pPLEX series for use in monocots," Functional plant biology, 30(4):453-460.
Shimamoto et al., (1989). "Fertile transgenic rice plants regenerated from transformed protoplasts," Nature, 338(6212):274-276.
Shtark et al., (2016). "Arbuscular mycorrhiza development in pea (*Pisum sativum* L.) mutants impaired in five early nodulation genes including putative orthologs of NSP1 and NSP2," Symbiosis, 68(1):129-144, 16 pages.
Smit et al., (2005). "NSP1 of the GRAS protein family is essential for rhizobial Nod factor-induced transcription," Science, 308:1789-1791.
Stevens, (2019). "Nitrogen in the environment: inequalities and our changing relationship with nitrogen," Science, 363(6427):578-580, 5 pages.
Sun et al., (2015). "Activation of Symbiosis Signaling by Arbuscular Mycorrhizal Fungi in Legumes and Rice," Plant Cell, 27:823-838.
van Zeijl et al., (2015). "The strigolactone biosynthesis gene DWARF27 is co-opted in rhizobium symbiosis," BMC Plant Biology, 15:260, 15 pages.

(56) References Cited

OTHER PUBLICATIONS

Velten et al., (1984). “Isolation of a dual plant promoter fragment from the Ti plasmid of Agrobacterium tumefaciens,” The EMBO Journal, 3(12):2723-2730.
Velten et al., (1985). “Selection-expression plasmid vectors for use in genetic transformation of higher plants,” Nucleic Acids Research, 13(19):6981-6998.
Verdaguer et al., (1998). “Functional organization of the cassava vein mosaic virus (CsVMV) promoter,” Plant molecular biology, 37(6):1055-1067.
Wang et al., (1998). “Improved vectors for Agrobacterium tumefaciens-mediated transformation of monocot plants,” ISHS Acta Horticulturae 461: International Symposium on Biotechnology of Tropical and Subtropical Species Part 2, 461 (pp. 401-408).
Weising et al., (1988). “Foreign genes in plants: transfer, structure, expression, and applications,” Annual review of genetics, 22(1):421-477.
Zhang et al., (1991). “Analysis of rice Act1 5' region activity in transgenic rice plants,” The Plant Cell, 3(11):1155-1165.
Zhang et al., (2013). “New technologies reduce greenhouse gas emissions from nitrogenous fertilizer in China,” Pnas USA, 110(21):8375-8380.

* cited by examiner

-N-P

| Root No. | 14d | 21d |
|---|---|---|
| R1 | weak spiking (7/10) | weak spiking (8/10) |
| R2 | No spiking (0/10) | Good spiking(8/10) |
| R3 | No spiking (0/10) | Good spiking(7/10) |
| R4 | Good spiking(10/12) | Good spiking(10/10) |

| | |
|---|---|
| HORVU5Hr1G117780.1 | NSP1a |
| HORVU2Hr1G040860.5 | NSP1b |
| HORVU7Hr1G060780.1 | NSP1c |
| HORVU7Hr1G115720.3 | NSP1d |
| HORVU5Hr1G097760.3 | NSP1e |
| HORVU2Hr1G104160.1 | NSP1f |

```
MtNSP1_Medtr8g020840.1        -------------------MTME-----PNPTSDHILDWLEGSVSFF--PSFLDDP--YN 32
Glymax_Glyma.07G039400.1      -------------------MIME-----PNPTPDHSLDWFEGSVSYF--PPFLDYP--YN 32
Glymax_Glyma.16G008200.1      -------------------MIME-----PNPTSDHSLDWFEGSVSYF--PPLLDYP--YD 32
HORVU1Hr1G066390.1            ------------------------------------------------------------ 0
Horvul_HORVU2Hr1G104160.1     ------------------------------------------------------------ 0
Horvul_HORVU2Hr1G104170.1     ------------------------------------------------------------ 0
Horvul_HORVU7Hr1G060780.1     ------------------------------------------------------------ 0
Horvul_HORVU7Hr1G115720.3     ------------------------------------------------------------ 0
Horvul_HORVU5Hr1G097760.3     ------------------------------------------------------------ 0
Horvul_HORVU2Hr1G040860.5     ------------------------------------------------------------ 0
Horvul_HORVU5Hr1G117780.1     ------------------------------------------------------------ 0
Manesc_Manes.11G019900.1      ----------------MTIEEPE-----PNLISDHILDWLEDSASFL--PSFFDDPSNYN 37
Manesc_Manes.04G145200.1      ----------------MTLEEPE-----PNHISDHILDWLEDSASFL--PSFLDDP--YS 35
LOC_Os05g42130.1              ------------------------------------------------------------ 0
Orysat_LOC_Os03g29480.1       ----------------MSYHEEERHG-------GNGLDWFEESMSSLLAAD-VDL-AGGG 35
PGSC0003DMP400061367(nsp1)    MTKHQNILSHHNFCDTMTIEEPE-----PNSNSDPISEWLASTLSDV--PSFLDEPYSYT 53
Traes_2BL_88A78A71E.1(nsp1)   ----------------MNYHEQEDQGLAVVATNNDGLDWLEDSVSL-LAGD-IDL----- 37
Vigung_Vigun10g164000.1       -------------------MIME-----PNPTSDHSLDWFEASVSFFPLPPFLDEP--YN 34
Zeamay_Zm00008a029343         ----------------MNNERESQ-----EPAAATTSDWLDESIAFL-AAN-LD------ 31
Zeamay_Zm00008a001715         -------------MKPMSCHEQEHPELA-ATTTNSGFDWLEDPISFL-TAD-VDI-A--- 40
Zeamay_Zm00008a035164         -------------------MPEQHAELA-AATTNSGFDCLEDPISFL-TAD-VDA-A--- 34
```

FIG. 26A

```
MtNSP1_Medtr8g020840.1         NG-YIHEYEIWNQNQD--ISNQYQ-IDANTNSSNATNSTT----NIVAASTTTSTTSLE-  83
Glymax_Glyma.07G039400.1       SS-DIQEYQLWEQ--D--IASNYQ-TDTNTS-SPNAT-------NI-----VTITTPLET  73
Glymax_Glyma.16G008200.1       SG-DIQDYQLWEQ--D--ITSHYQ-TDTNTSSSPNAT-------NI-----STTTTPLET  74
HORVU1Hr1G066390.1             ------------------------------------------------------------  0
Horvul_HORVU2Hr1G104160.1      ------------------------------------------------------------  0
Horvul_HORVU2Hr1G104170.1      ------------------------------------------------------------  0
Horvul_HORVU7Hr1G060780.1      ------XXXXXXXX-XTAVEPHRPHTIAEPHRPAAQPNPIAPPLALAHAHPSPSIA---S  50
Horvul_HORVU7Hr1G115720.3      ---------TNCRY----------------------------VYTSPLFLRRGRTC---L  20
Horvul_HORVU5Hr1G097760.3      ---------------------------------------APPPCAFTKLTKRPSLH---L  18
Horvul_HORVU2Hr1G040860.5      ----------------------MLHLL-------LQRKTVTPPRK-KEPIKYRNLR---T  27
Horvul_HORVU5Hr1G117780.1      ------------------------------------------------------------  0
Manesc_Manes.11G019900.1       SG-DVNGCQWWNQTEE--ICQGLS-ST----------------------T-NTTLNAPSD  70
Manesc_Manes.04G145200.1       SS-DIYSYQWWNQTEE--ICQDPI-NNNASLSSSTS--------TAVNAD-STSLIEASN  82
LOC_Os05g42130.1               ------------------------------------------------------------  0
Orysat_LOC_Os03g29480.1        GDAGGGGYAWWWAASPAAQQDDIGSVVAQTLSPPSTAAP---------AAASPSIA---S  83
PGSC0003DMP400061367(nsp1)     DDLNFYADSWWVPDQDDQIVNHNI-IIDNTCNSFNISSPV---------NTAISNIPLE-  102
Traes_2BL_88A78A71E.1(nsp1)    ----GGSYGWWCDI-LPAQKDDIGSVVAQTLSP-----PAPPATSSPLAHPSPSIA---S  84
Vigung_Vigun10g164000.1        SS-DI---QLWEQ--D--ISSQYQ-TDANTS-SPNAT-------NI-----ATSTTPPEP  72
Zeamay_Zm00008a029343          --LGFNDYGWPSASEAQERHDDVRSMIVETLAPTATTLHQPS-LNLDISV--ASSS---S  83
Zeamay_Zm00008a001715          ----AGGYGWWSD-PAAAQQDGIGSVVAQTLSPPA-------PL---LAHTSPSIA---S  82
Zeamay_Zm00008a035164          ---GCGGYGWWSDDPAAAQQDDIGSVVAQTLSPPAAPLLTTNPP---LAHTSPSIA---S  85
```

FIG. 26B

```
MtNSP1_Medtr8g020840.1         PNSFNNIPFSDLPKKRNAEDELSLKKQPQN-QKNKR-LKSR-PMNESDNGD----AALEG  136
Glymax_Glyma.07G039400.1       CDSN-NLPLSDLPKKRSATDE-SSPKPPQN-HKHKK-IKSK-PRNNEADNGDAEATTTTT  128
Glymax_Glyma.16G008200.1       CDSNNNLPLSDLPKKRNATDE-SSPKPPQN-HKHKK-IKSK-PINNEAYTGHAEGTT--T  128
HORVU1Hr1G066390.1             ----------------------------------------------------------ME  2
Horvul_HORVU2Hr1G104160.1      ------------------------------------SGNQRRR-----------------  7
Horvul_HORVU2Hr1G104170.1      ------------------------------------------------------------  0
Horvul_HORVU7Hr1G060780.1      PAA-------SEPSPGKR----KSPVR-VGSGSGQGSSNQRRR-----------------  81
Horvul_HORVU7Hr1G115720.3      PEC-------RR-CNRAC----ACAAM-QAGGRGKATTNKQGWIDAFS-SSE----MGPW  62
Horvul_HORVU5Hr1G097760.3      RRR----------LRVQL----PLPVRLAVSGSGHGSRNQRRR-----------------  47
Horvul_HORVU2Hr1G040860.5      MHL-------RRGLRVQL----PLPVRLAVSGSGHGSSNQRHR-----------------  59
Horvul_HORVU5Hr1G117780.1      --L-------RRRLRVQL----PLPVRLALSGSGHGSSNQRRR-----------------  30
Manesc_Manes.11G019900.1       PTSSNHQQPSNSSRKRGATGD-PVPKTSQNHHQGKK-QNHRIRISNEDQDG---EQVIEV  125
Manesc_Manes.04G145200.1       PTTSNHQQLSNLSRKREAADD-PLPQTSHHH-QRKK-QNH--RISNEDQDG---EQAVEV  134
LOC_Os05g42130.1               -------------------------------------------MD-------------ME  4
Orysat_LOC_Os03g29480.1        PAA-------SSPSDVPS----SSS--------------KKRKS-----PAH----RAPG  109
PGSC0003DMP400061367(nsp1)     PIILDQPQPVDLSKKRKISDQNPKT--SKK--------NHNRQINEAE-NAHTIG----D  147
Traes_2BL_88A78A71E.1(nsp1)    PAA-------SEPSPKKR----KSPAR-VVSGSGHSSSNNQRRR----------------  116
Vigung_Vigun10g164000.1        CASN-NLPLSDLPKKRSATTDDSSLRPPQNHHKYKK-IKSK-TMNSEADSGDAEGT----  125
Zeamay_Zm00008a029343          PMTS-QQEF-GQPKKRKSSGN-SSSQRPHVGGGGQQE--------------------KGG  120
Zeamay_Zm00008a001715          PVV-------SEPSSKKR----KSPAH---RASASTGSNQRRADQ-D---------RPG  118
Zeamay_Zm00008a035164          PAV-------SEPSSKKR----KSPAH---RASAHSGSNQRRAEQAD---------RPG  122
```

FIG. 26C

```
MtNSP1_Medtr8g020840.1         TVVRKSGGNKKGAAKANGSNSNNGNNKDGRWAEQLLNPCA---VAITGGNLNRVQHLLYV  193
Glymax_Glyma.07G039400.1       ATVRKSGGNKKGGAKANGN---NCNNKDGRWAEQLLNPCA---AAITGGNLNRVQHLLYV  182
Glymax_Glyma.16G008200.1       TTVRKSGGNKKGGAKANGN---NCNNKDGRWAEQLLNPCA---AAITGGNLNRVQHLSYV  182
HORVU1Hr1G066390.1             QELRSGGA---VRAQSTMCFSGA--LVDGPRIQQLLLHCA---AALESNDVTLAQQAMWV  54
Horvul_HORVU2Hr1G104160.1      TEQDRPGGGKK--------GGGAGSDRDARWAEQLLGPCA---VAVEARNLSRVQHLFYV  56
Horvul_HORVU2Hr1G104170.1      ------------------------------------------------------------  0
Horvul_HORVU7Hr1G060780.1      TEQDRPGGGKK--------GGRAGSDRDARWAEQLLGPCA---VAFEARNLSRVQHLFYV  130
Horvul_HORVU7Hr1G115720.3      ASRSGVGPGRE------VGGAAAGSLRRRRRGAQPVPRATPLLRARRARGLLRRRQP---  113
Horvul_HORVU5Hr1G097760.3      TEQDRPGGGKK--------GGGAGSDRDARWAEQLLGPCA---VAVEARNLSHVQHLFYV  96
Horvul_HORVU2Hr1G040860.5      TEQDRPGGGKK--------GGGAGSDRDARWAEQLLGPCA---VAVEARNLSRVQHLFYV  108
Horvul_HORVU5Hr1G117780.1      IEQDRPGG-------------GAGSDRDARWAEQLPGPCA---VAVEARNLSRVQHLFYV  74
Manesc_Manes.11G019900.1       VAGKRSYRKNKGNSKSTGNNGNNGNNKEGRWAEDLLNPCA---AAITTGNFSRVQHFLYV  182
Manesc_Manes.04G145200.1       VAGKKSNGNKKINSK---NAGNNGNNREGRWAEHLLNPCA---AAITIGNLSRVQHLLYV  188
LOC_Os05g42130.1               HELRGGGVGAAAHGHGSICFSGGPVLVDGRRIQQLLLHCA---AALESNDVTLAQQAMWV  61
Orysat_LOC_Os03g29480.1        HTGGKKGGGGK--------GGGGGSDRDMRWAEQLLNPCA---VAVEAGNLSRVQHLFYV  158
PGSC0003DMP400061367(nsp1)     QGGVQVRRPKRVTTK---STGNNSNNKEGRWAEHLLNPCA---AAITVGNMNRVQHLLYV  201
Traes_2BL_88A78A71E.1(nsp1)    TEQDRPGGGKK--------GGGAGSDRDARWAEQLLGPCA---VAVEARNLSRVQHLFYV  165
Vigung_Vigun10g164000.1        TTVRKPGGNKRGTAKGVAN---NCNNKEGRWAEQLLNPCA---AAITGGNLSRVQHLLYV  179
Zeamay_Zm00008a029343          ASCARPKPGKK----GSGKGAAATLDREARWAEQLLNPCA---AAIEAGNLPRTQHLLYV  173
Zeamay_Zm00008a001715          A-GSGGGGSKR----SGSKGGGAGSDRDTRWAEQLLNPCA---AAVEAGNLSRVQHLFY-  169
Zeamay_Zm00008a035164          A-GG------------GKKGGGAGSDRDTRWAEQLLNPCA---AAVEAGNLTRVQHLFY-  165
```

FIG. 26D

| | | |
|---|---|---|
| MtNSP1_Medtr8g020840.1 | LHELASTTGDANHRLAAHGLRALTHHLSSSSS----S-------TPSGTITFASTEPRFF | 242 |
| Glymax_Glyma.07G039400.1 | LHELASPTGDANHRLAAHGLKALTQHLSSSPT----S-------TSSGSITFASAEPRFF | 231 |
| Glymax_Glyma.16G008200.1 | LHELASPTGDANHRLAAHGLKALTQHLSSSP--------------SSGSITFASSEPRFF | 228 |
| HORVU1Hr1G066390.1 | LNNIASAQGDPNQRLTSSLLRGLVARACRTCGSPRADSMG--------PPPALGSQRAMS | 106 |
| Horvul_HORVU2Hr1G104160.1 | LGELAAFSGDANHRLAAYGLRALSLRLPAAVGPAAAAAVRVPAACECPTPSFAGAEPRLF | 116 |
| Horvul_HORVU2Hr1G104170.1 | ------------------------------------------------------------ | 0 |
| Horvul_HORVU7Hr1G060780.1 | LGELAAFSRHPKHRLAAYGLRALSLRLPTAVGPAAAAAVRVPAACECPTPSIAGAEPRLF | 190 |
| Horvul_HORVU7Hr1G115720.3 | ----QACRVRAASALASPPCRSW---PRGRRGREGAGRM------RVPDAVARRAEPRMF | 160 |
| Horvul_HORVU5Hr1G097760.3 | LGELAAFSGDANHRLAAYGLRALSLRLPAAVGPAAAAAVRVPAACECPTPSFAGTEPRLF | 156 |
| Horvul_HORVU2Hr1G040860.5 | -GELAAFSGDANHRLAAYGLRALSLRLPAAVGPA---AVRVPAACECPTPSFAAAEPRLF | 164 |
| Horvul_HORVU5Hr1G117780.1 | LGELAAFSGDANHRLAAYGLRALSLRLPAAVGPAAAAAVRVPAACECLTPSFAGAEPRLF | 134 |
| Manesc_Manes.11G019900.1 | LHELASSAGDANHRLAFFGLQALTHHLSSSTT----S-------ASVGPISFTSIEPKFF | 231 |
| Manesc_Manes.04G145200.1 | LHELASSTGDANHRLAFYGLRALNHHLSSSTT----S-------ASIGPISFASTEPKFF | 237 |
| LOC_Os05g42130.1 | LNNIASSQGDPSQRLTSWLLRALVARACRLCAAAPAGAAVE----FLERGRAPPWGRAMS | 117 |
| Orysat_LOC_Os03g29480.1 | LGELESFSGDANHRLAAHGLRALARWLPAAVGPAAAAAVRVPPCSERPTTAFAAAEPRLF | 218 |
| PGSC0003DMP400061367(nsp1) | LHELASFTGDANHRLAAHGLRALTHHLSSPGSSSASS-------GTIGVTNFSSANHKFF | 254 |
| Traes_2BL_88A78A71E.1(nsp1) | LGELAAFSGDANHRLAAYGLRALSLRLPAAVGPAAAAAVRVPAACESPTPSFAGAEPRLF | 225 |
| Vigung_Vigun10g164000.1 | LHELASPTGDANHRLAAHGLKALTLHLSSSLA----S-------TSSGSMTFASTEPRFL | 228 |
| Zeamay_Zm00008a029343 | LGELASFSGDPNHRLAAHGLRALTRRLPHATGQAALATVKVPP-CECPTSVFSGVDPRLF | 232 |
| Zeamay_Zm00008a001715 | ------------------------------------------------------------ | 169 |
| Zeamay_Zm00008a035164 | ------------------------------------------------------------ | 165 |

FIG. 26E

```
MtNSP1_Medtr8g020840.1         QKSLLKFYEFSPWFSFPNNIANASILQVLAEE--P-NNLRTLHILDIGVSHGVQWPTFLE  299
Glymax_Glyma.07G039400.1       QKTLLKFYEVSPWFSFPNNIANASILQVLGED--TD-NSRTLHILDIGVSHGMQWPTFLE  288
Glymax_Glyma.16G008200.1       QKTLLKFYEVSPWFSFPNNIANASILQVLGED--TDNNSRTLHILDIGVSHGMQWPTFLE  286
HORVU1Hr1G066390.1             VTELADYVDLTPWHRFGFTASNGAILRAVA-------GRNAVHVVDLGVTRCMQWPTLID  159
Horvul_HORVU2Hr1G104160.1      RASLIKFHEVSPWFTLPNTLANAAISQL------ASAAPRPLHLVDIGVSHGVQWPTLLE  170
Horvul_HORVU2Hr1G104170.1      ------------------------------------------------------------  0
Horvul_HORVU7Hr1G060780.1      RASLVKFHEVSPWFTLLNTLANAAISQL------ASAAPRPLHLVDIGVSHGVQLPTLLE  244
Horvul_HORVU7Hr1G115720.3      RASLIKFHEVSPWFTLPNTLANAAISQL------ASAAPRPLHLVDIDVSHEVQWPTLLE  214
Horvul_HORVU5Hr1G097760.3      HASLIKFHEVSPWFTLPNTLANAAISQL------ASAAPRPLHLIDIGVSHGVQWPTLLE  210
Horvul_HORVU2Hr1G040860.5      RASLIKFHEVCSWFTLPNTLANAAISQL------ASP---ALHLIDIGVSHGVQWPTLLE  215
Horvul_HORVU5Hr1G117780.1      RASLIKFHEVSSWFMLPNTLANAAISQL------ASP---ALHLIDIGVSHGVRWPTLLE  185
Manesc_Manes.11G019900.1       QRSLLKFYEISPWFSFPNNIANSSILQILAQE--LD-HKQSLHILDIGVSHGVQWPTLLE  288
Manesc_Manes.04G145200.1       QRSLIKFYEVSPWFAFPNNIANSSILQILAQE--LD-HKRNLHILDIGVSHGVQWPTLLE  294
LOC_Os05g42130.1               VTELADYVDLTPWHRFGFTASNAAILRAVA-------GASAVHVVDLSVTHCMQWPTLID  170
Orysat_LOC_Os03g29480.1        RASLIRFHEVSPWFALPNALANAAIAQASTC-GAAGATPRPLHVVDLGVSHGVQWPTLLE  277
PGSC0003DMP400061367(nsp1)     RDSLINFIDISPWFRIPNNIANSSVLQIIGEQ--D--RLKNLHILDIGVSHGFQWPTLLE  310
Traes_2BL_88A78A71E.1(nsp1)    RASLIKFHEVSPWFTLPNTLANAAISQL------ASAAPRPLHLVDIGVSHGVQWPTLLE  279
Vigung_Vigun10g164000.1        QKTLLKFYEVSPWFSFPNNIANASILQVLGED--ND-NSRTLHILDIGASHGMQWPTFLE  285
Zeamay_Zm00008a029343          RASLIRFNEVSPWFAVPNALANSAIAQAASRKKGAVAEPRQVHVVDIGVSHGVQWPTLLE  292
Zeamay_Zm00008a001715          ------------------------------------------------------WPTLLE  175
Zeamay_Zm00008a035164          ------------------------------------------------------WPTLLE  171
```

FIG. 26F

```
MtNSP1_Medtr8g020840.1          ALSRRP--GGPPPLVRLTVVNASSSTENDQNMETPFSIGPCGDTFSSGLLGYAQSLNVNL  357
Glymax_Glyma.07G039400.1        ALSRRA--GGPPPLVRLTVVTASSSTEN----DTPFCIGPPGDNFSSRLLGFAQSMNVNL  342
Glymax_Glyma.16G008200.1        ALSRRP--GGPPPLVRLTVVTASSSTEN----DTPFCIGPPGDNFSSRLLGFAQSMNVNL  340
HORVU1Hr1G066390.1              ALSKRP--GGAP-ALRITVPSV--------RPAGPPLLGVPDEEIGLRLANFAKSKGVQL  208
Horvul_HORVU2Hr1G104160.1       SLTRMA-AGRAPPSVRLTVVA---------TPPVPFSASPPGYDFSPHLLRYAKSIKLDL  220
Horvul_HORVU2Hr1G104170.1       ------------------------------------------------------------  0
Horvul_HORVU7Hr1G060780.1       SLTCMA-AGRAPPSVRLTVVA---------TPPVPFSASPPGYDFSSHLLRYAKSIKLDL  294
Horvul_HORVU7Hr1G115720.3       SLTRMA-AGRAPPFVRLTVVA---------TPPVPFSASPPGYDFSPHLLRYAKSIKLDF  264
Horvul_HORVU5Hr1G097760.3       SLTRMA-AGRAPLSVRLTVVA---------TPPVPFSASPPGYDFSPHLLPYAKSIKLDL  260
Horvul_HORVU2Hr1G040860.5       PSPAWPPDGRRRPSG---------------------------------------------  230
Horvul_HORVU5Hr1G117780.1       SLTRMA-AGRAPPSVRLTVVA---------TPPVPFSASPPGYDFSPHLLRYAKSIKLDL  235
Manesc_Manes.11G019900.1        ALTRRP--GGPPPLVRITVVTAT--VENDQNTDTPFSVGPPGDNFPPRLLNFAKSMNINL  344
Manesc_Manes.04G145200.1        ALSRRQ--GGPPPLVRITVVTAT--VENDQNTETPFSVGPPGDNFSTRLLSFAKCMNINL  350
LOC_Os05g42130.1                VLSKRP--GGAP-AIRITVPSV--------RPAVPPLLAVSSSELGARLAIFAKSKGVQL  219
Orysat_LOC_Os03g29480.1         SLTRQP-GGRAPPSVRLTVVGPGAT---ATSPVAPFSASPPGYDFSPHLLRYAKSINLDL  333
PGSC0003DMP400061367(nsp1)      ELTRRS--GGPPPLVRLTVITPT--TENGELRGTPFVIGPPGYDFSSQLLAYAKAININL  366
Traes_2BL_88A78A71E.1(nsp1)     SLTRMA-AGRAPPSVRLTVVA---------TPPVPFSASPPGYDFAPHLLRYAKSIKLDL  329
Vigung_Vigun10g164000.1         ALSRRP--GGPPPLVRLTVVTASS-SEI----DTPFSIGPPGDNFSSRLLGFAQLMNVNL  338
Zeamay_Zm00008a029343           ALTRVP-RGSTPPSVRLTLVGPTA------TPPVPFSASPPGYDCSPQLLRYAKSIDLDL  345
Zeamay_Zm00008a001715           SLTRLP-GGRAPPSVRLTVAG---------APPAPFSASPPGYDFSPHLLRYAKSIDLRL  225
Zeamay_Zm00008a035164           SLTRLP-GGRAPPSVRLTVAA---------APPAPFSASPPGYDFSPHLLRYAKSISLQL  221
```

FIG. 26G

```
MtNSP1_Medtr8g020840.1         QIKKLDNHPLQTLN-----------------AK-SVDTSSDETLIVCAQFRLHHLNHNNP  399
Glymax_Glyma.07G039400.1       QINKLDNCPLHSLN-----------------AQ-SVDASPDEIFVVCAQFRLHQLNHNAP  384
Glymax_Glyma.16G008200.1       QINKLDNCPLHTLN-----------------AQ-SVDTSPDEIFVVCAQFRLHQLNHNAP  382
HORVU1Hr1G066390.1             EFNVVNKSTATSTPSPAKLQTVCQELGSVLSDPPALRLRDSEALVVNCQSWLRHVA---P  265
Horvul_HORVU2Hr1G104160.1      EIGRAASLD--SAH-----------------GFCTAP---DEALVVCLQFRLGHVT---A  255
Horvul_HORVU2Hr1G104170.1      ------------------------------------------------------------  0
Horvul_HORVU7Hr1G060780.1      EIGRATSLD--SAH-----------------GFYTAP---NKARVVCLQFRLGHVT---A  329
Horvul_HORVU7Hr1G115720.3      EIGRAASLD--SAH-----------------GFCTAP---DEALVVCLQFRLGHVT---A  299
Horvul_HORVU5Hr1G097760.3      EIGRAASLD--SAH-----------------GFCTAP---DEALVVCLQFRLGHVT---A  295
Horvul_HORVU2Hr1G040860.5      ------------------------------------------------------------  230
Horvul_HORVU5Hr1G117780.1      EIGRAASLD--SAH-----------------GFCTAP---DEALVVCLQFLLGHVT---A  270
Manesc_Manes.11G019900.1       QINRLDNIPLQKLN-----------------GQ-IINTNPEEILIVCAQFRLHHLNHNNP  386
Manesc_Manes.04G145200.1       QINRLDNHPLQNLN-----------------GQ-VMNTDPEETLIVCAQFRLHHLNHNTP  392
LOC_Os05g42130.1               EFNVVESATTTSP--KKTSTTLCQELASVLSDPPSLGLRDGEAVVVNCQSWLRHVA---P  274
Orysat_LOC_Os03g29480.1        RISRAATLD--DAV-------------------PGDD---GEALVVCLQFRLGHAA---A  366
PGSC0003DMP400061367(nsp1)     QINRLDNFPLQNLN-----------------SQ-IINSTSDETLVICAQFRLHNLNHTIP  408
Traes_2BL_88A78A71E.1(nsp1)    EIGRAASLD--PAH-----------------GLCTTP---DEALVVCLQFRLGHVS---A  364
Vigung_Vigun10g164000.1        QIKRLDNCPLHTLS-----------------AQ-SVDTSPDEIFVVCAQFRLHQLSHNST  380
Zeamay_Zm00008a029343          AIVQAPCLD--TLR-----------------GT-LTP---GETLVVCLQFRLGLAT---A  379
Zeamay_Zm00008a001715          AISRAASLD--SVH-----------------GLASSP--SGEALVVCLQFRLGHAG---A  261
Zeamay_Zm00008a035164          AISRAASLD--SVR-----------------GLASPSASGEEALVVCLQFRLGHAS---A  259
```

FIG. 26H

```
MtNSP1_Medtr8g020840.1          DE---RSEFLKVLRGMEPKGVILSENNMECCC--SSCGDFATGFSRRVEYLWRFLDSTSS  454
Glymax_Glyma.07G039400.1        DE---RSKFLTVLRNMEPKGVILSDNNLGCCC--NCCGDFATGFSRRVEYLWRFLDSTSS  439
Glymax_Glyma.16G008200.1        DE---RSEFLKVLRNMEPKGVILSDNNMGCCC--NCCGDFTTGFSRRVEYLWRFLDSTSS  437
HORVU1Hr1G066390.1              GS---RDGFMDAVRALDPCLVTVTDEDADL-----DSPSLATRIAGCFNFHWILFDALDT  317
Horvul_HORVU2Hr1G104160.1       EE---RTDIIR-------------------------------------------------  263
Horvul_HORVU2Hr1G104170.1       -------------XDLKPQLVVLSELDVG------GNGSAAGEFTARLELLWRFLESTHA  41
Horvul_HORVU7Hr1G060780.1       EE---RMDIIRRVKDLKPQRVVLSGLDVG------GNGSVAGESTARLELLWRFLESTHE  380
Horvul_HORVU7Hr1G115720.3       EE---RTYIIRRVKDLKPQLMVLSELDVW------GNGSTAGEFTARLELLWRFLESTHA  350
Horvul_HORVU5Hr1G097760.3       EE---RTDIIRRVKDLKPQLVVLSELDVG------GNDSAAGEFTARLELLWRFLESTHA  346
Horvul_HORVU2Hr1G040860.5       ------------------------------------------------------------  230
Horvul_HORVU5Hr1G117780.1       EE---RTDIIRRVKDLKPQLVVLSELDVG------GNGSAAGEFTARLELLWQFLESTHA  321
Manesc_Manes.11G019900.1        DE---RTEFLRFLRDMEPKGVVLSENNADCSC--NSCGDFATGFSRRVDYLWKFLDSTSS  441
Manesc_Manes.04G145200.1        DE---RTEFLRILRGLQPKGVILSENNTDCSC--NSCGDFATGFSRRVDYLWKFLDSTSS  447
LOC_Os05g42130.1                DT---RDLFLDTVRALNPCLLTVTDEDADL-----GSPSLASRMAGCFDFHWILLDALDM  326
Orysat_LOC_Os03g29480.1         EE---RREVLRKARGLNPELVVLSELDSGVGVVGGDGGSAAGEFAARLELLWRFLESTSA  423
PGSC0003DMP400061367(nsp1)      DD---RTDLLKILKSLDPKGLVLSENNTECSC--NSCGDFATMFSRRVEYLWRFLDSTSV  463
Traes_2BL_88A78A71E.1(nsp1)     EE---RADIIRRVKDLKPHLVVLSELDVG------GNGSAAGEFTARLELLWRFLESTHA  415
Vigung_Vigun10g164000.1         DEKSEKSEFLKVLRNMEPKGVILSDNNMECCC--NCCGDFATGFSRRVEYLWRFLDSTSS  438
Zeamay_Zm00008a029343           DD---QAAIFRKVRDLNPELMVFTELDGGRR----NDDSATSEFAARLELLWRFLDSTAA  432
Zeamay_Zm00008a001715           DE---RTEILRKVRGLNPELVVVSELDGG------GDGTAAGEFTARLELLWRFLEST--  310
Zeamay_Zm00008a035164           DE---RTEILRKVRGLDPELVVVSELDSG------GDGTAAGEFTARLELLWRFLES---  307
```

FIG. 26I

```
MtNSP1_Medtr8g020840.1          AFKNRDSDERKMMEGEAAKALTNQ--------REMNERREKWCERMKEAGFAGEVFGEDA  506
Glymax_Glyma.07G039400.1        AFKGRESEERRVMEGEAAKALTNQ--------RETNEGKEKWCERMKEAGFVEEVFGEDA  491
Glymax_Glyma.16G008200.1        AFKGRESDERRVMEGEAAKALTNQ--------RETNEGKEKWCERMKEAGFVGEVFGEDA  489
HORVU1Hr1G066390.1              SA-PRDS--PRRLEHEAAVGQKIESVVGA-DGTERSESGARLAERMRRKGFAGVGFGEDE  373
Horvul_HORVU2Hr1G104160.1       ------------------------------------------------------------  263
Horvul_HORVU2Hr1G104170.1       AFKGRDGEDRRLLEAEAGTGVAVAA-------AREAMGREGWRDRMTAAGFDQVAFGGEA  94
Horvul_HORVU7Hr1G060780.1       AFKGRDGKDRRLLEXXAGTAVAVAA-------AREATGRKGWRDRMTAAGFDQVVFGGEV  433
Horvul_HORVU7Hr1G115720.3       AFKGRDGEDRRLLEAEAGSAVAVAA-------AREAVGREGWRDRMTAAGFDQVAFGGEA  403
Horvul_HORVU5Hr1G097760.3       AFKGRDGEDRRLLEAEAGTAVAVAA-------AREAVG----------------------  377
Horvul_HORVU2Hr1G040860.5       ------------------------------------------------------------  230
Horvul_HORVU5Hr1G117780.1       TFKGRDGKDRRFLEAEAGTAVAVAA-------AREAVGREGWRDRMTATGFEQVAFGGEA  374
Manesc_Manes.11G019900.1        AFKGRDSEERRVMEGEAAKALTNR--------GEMNEGKERWCERMRRVGFVGEVFGEDA  493
Manesc_Manes.04G145200.1        AFKGRESEERRLMEGEAAKALTNR--------GEMNEGKEKWCERMRRVGFVSEVFGEDA  499
LOC_Os05g42130.1                SA-PKDS--PRRLEQEAAVGRKIESVIGEEDGAERSEPGARLAERMSRKGFAGVVFDEEA  383
Orysat_LOC_Os03g29480.1         AFKGKDVEERRLLEAEAGAILAAADV------AAAGEGREGWRERMAAAGFEEAPFGAEA  477
PGSC0003DMP400061367(nsp1)      AYKGRESEERKMMEGEAAKALTNM--------GEMNERKEKWCERMRNVGFVKEVFGEDA  515
Traes_2BL_88A78A71E.1(nsp1)     AFKGRDGEDRRLLEAEAGTAVAVAA-------AREAMGREGWRDRMAAAGFDQVAFGGEA  468
Vigung_Vigun10g164000.1         AFKGRDSDERRVMEGEAAKALTNQ--------REMNEGKEKWCERMKEAGFVGEVLGEDA  490
Zeamay_Zm00008a029343           AFKGMDADERRVMEAEAGTALALTPRC----GATVDGGREAWRARLAAAGFEEAAFGGEA  488
Zeamay_Zm00008a001715           ------------------------------------------------------------  310
Zeamay_Zm00008a035164           ------------------------------------------------------------  307
```

FIG. 26J

```
MtNSP1_Medtr8g020840.1          IDGGRALLRKYDNNWEMKVEE----NSTSVELWWKS------QPVSFCSLWKLDKQPE--  554
Glymax_Glyma.07G039400.1        IDGGRALLRKYESNWEMKVED----DNRSVGLWWKG------QSVSFCSLWKLDGNDQSS  541
Glymax_Glyma.16G008200.1        IDGGRALLRKYDGNWEMKVED----DNTSVGLWWKG------QSVSFCSLWKLDGNYKTS  539
HORVU1Hr1G066390.1              VAEVRHLLSEHATGWGVKREE------DMLVLTWKG------HAAVFTTAWAPN------  415
Horvul_HORVU2Hr1G104160.1       ------------------------------------------------------------  263
Horvul_HORVU2Hr1G104170.1       VESARSLLRKYDNGWEMSTAAAATGGGGAVALRWKG------QPVSFCSLWRPA------  142
Horvul_HORVU7Hr1G060780.1       VESARSLLRKYDNGWEMSTVAAAKGGGGAVALRWKG------QPVSFCSLWRPA------  481
Horvul_HORVU7Hr1G115720.3       VESARSLLRKYDNGWEMSTTAAATGGGGAVALRWKG------QPVSFCSLWWRA------  451
Horvul_HORVU5Hr1G097760.3       ------------------------------------------------------------  377
Horvul_HORVU2Hr1G040860.5       ------------------------------------------------------------  230
Horvul_HORVU5Hr1G117780.1       VESARSLLRKYDNGWESPRRRRRREA----AAPWRCGGKGSRCPSARCGRRRSSGS----  426
Manesc_Manes.11G019900.1        IDGGRALLRKYDSNWEMKIEE----KDECVGLWWKG------QPVSFCSLWKLDMNMKGK  543
Manesc_Manes.04G145200.1        IDGGRALLRKYDSNWEMRIEE----TDGCIGLRWKG------LPVSFCSLWKLDLKGNDS  549
LOC_Os05g42130.1                AAEVRRLLSEHATGWGVKRED------DMLVLTWKG------HAAVFTGAWTPN------  425
Orysat_LOC_Os03g29480.1         VESARSLLRKYDSGWEMSAPSP---AAAAVALRWKG------QPVSFCSLWRPAA-----  523
PGSC0003DMP400061367(nsp1)      IDGARALLRKYDSNWEMRVEE----KDGCVDLWWKG------QPISFCSLWKI-------  558
Traes_2BL_88A78A71E.1(nsp1)     VESARSLLRKYDNGWEMSTAAAATGGGGAVALRWKG------QPVSFCSLWRPA------  516
Vigung_Vigun10g164000.1         IDGGRALLRKYDSNWEMKVED----DNRSVGLWWKG------QPVSFCSLWKLDGNDQSS  540
Zeamay_Zm00008a029343           VETAKALLRKYDGGWELVLPSPS--AAAAVGLRWEG------QPVSFSSMWRPAQASPVL  540
Zeamay_Zm00008a001715           ---------KYDGGWEMSAS----GTAGAVALRWKG------QPVSFCSLWRPACSG---  348
Zeamay_Zm00008a035164           ------------------------------------------------------------  307
```

FIG. 26K

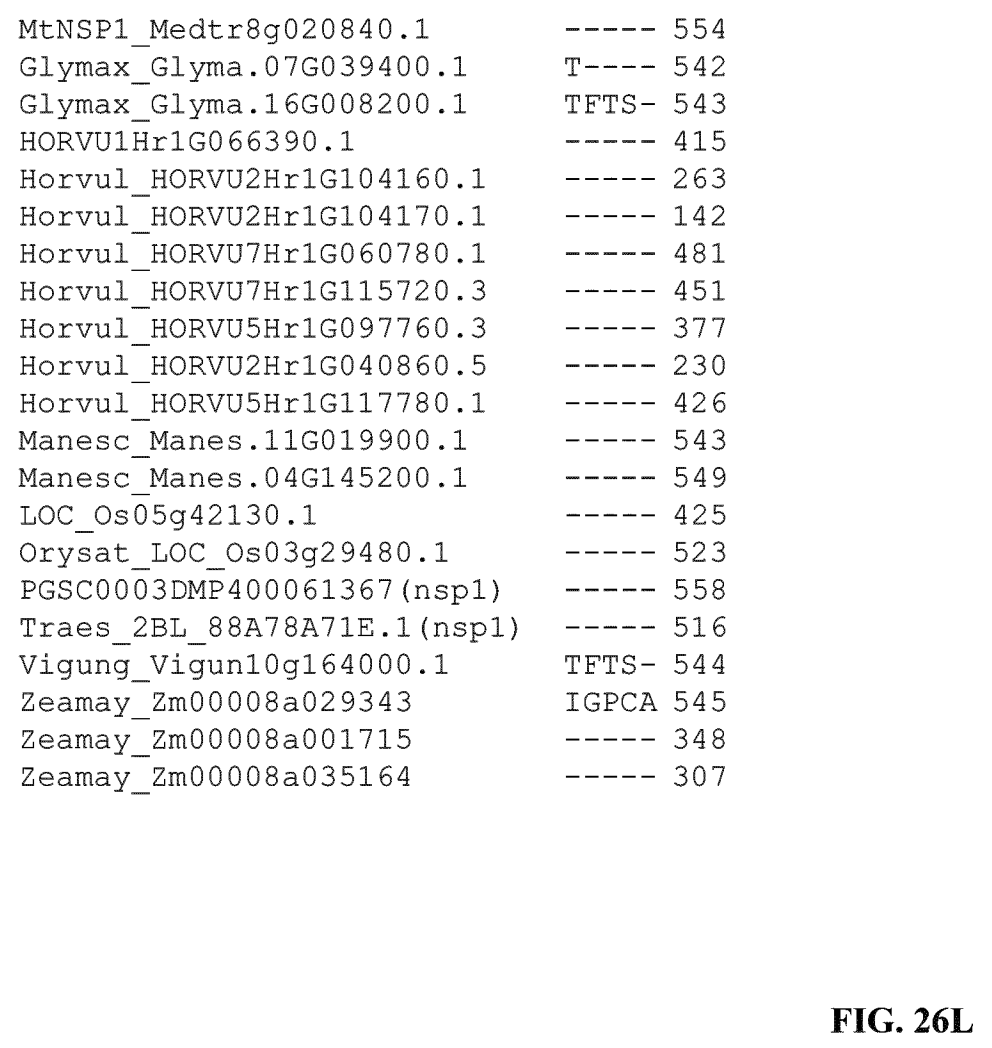

```
MtNSP1_Medtr8g020840.1         ----- 554
Glymax_Glyma.07G039400.1       T---- 542
Glymax_Glyma.16G008200.1       TFTS- 543
HORVU1Hr1G066390.1             ----- 415
Horvul_HORVU2Hr1G104160.1      ----- 263
Horvul_HORVU2Hr1G104170.1      ----- 142
Horvul_HORVU7Hr1G060780.1      ----- 481
Horvul_HORVU7Hr1G115720.3      ----- 451
Horvul_HORVU5Hr1G097760.3      ----- 377
Horvul_HORVU2Hr1G040860.5      ----- 230
Horvul_HORVU5Hr1G117780.1      ----- 426
Manesc_Manes.11G019900.1       ----- 543
Manesc_Manes.04G145200.1       ----- 549
LOC_Os05g42130.1               ----- 425
Orysat_LOC_Os03g29480.1        ----- 523
PGSC0003DMP400061367(nsp1)     ----- 558
Traes_2BL_88A78A71E.1(nsp1)    ----- 516
Vigung_Vigun10g164000.1        TFTS- 544
Zeamay_Zm00008a029343          IGPCA 545
Zeamay_Zm00008a001715          ----- 348
Zeamay_Zm00008a035164          ----- 307
```

FIG. 26L

```
MtNSP2_Medtr3g072710.1          ------------------------------------------------------------ 0
Glymax_Glyma.13G081700.1        ------------------------------------------------------------ 0
Glymax_Glyma.04G251900.1        ------------------------------------------------------------ 0
Glymax_Glyma.06G110800.1        ------------------------------------------------------------ 0
HORVU4Hr1G020490.28             ---------------------------------------------------METMSYPCS 9
Horvul_HORVU4Hr1G061310.1       ------------------------------------SLCTCKIC------------APCP 12
Manesc_Manes.18G075300.1        ------------------------------------------------------------ 0
Manesc_Manes.02G161100.1        AGSLARIYRARGDKEGCCWVEWLGATGFKEVNISFANHCQAKLLLGLFNDGYRVEEMGCN 60
LOC_Os12g06540.1                ---------------------------------------------------METMSYPCS 9
LOC_Os11g06180.1                ------------------------------------------------------------ 0
Orysat_LOC_Os03g15680.1         ------------------------------------------------------------ 0
PGSC0003DMP400021345(nsp2)      ------------------------------------------------------------ 0
Traes_4AS_19FA06316.1(nsp2)     ------------------------------------------------------------ 0
Vigung_Vigun08g091300.1         ------------------------------------------------------------ 0
Vigung_Vigun09g168400.1         ------------------------------------------------------------ 0
Vigung_Vigun09g168500.1         ------------------------------------------------------------ 0
Zeamay_Zm00008a001015           ------------------------------------------------------------ 0
```

FIG. 27A

```
MtNSP2_Medtr3g072710.1          ---------------------------MDLMD-MDAINDLHFSGHSSLT---------N-  22
Glymax_Glyma.13G081700.1        ----------------------------MDMLIMDDPDFLDFSDHSIT-----------T  21
Glymax_Glyma.04G251900.1        ---------------------------------MEIDMDMDFSGYSTIT---------NT  18
Glymax_Glyma.06G110800.1        ------------------------------MD-IDAIHNLDFSGYSTIT---------NT  20
HORVU4Hr1G020490.28             PLLSLPTH----EES---------------------------------------------  20
Horvul_HORVU4Hr1G061310.1       PLSPRFPRAKTFQRGDKKQHSVTTREGAMDVTMEDVVGDLEISGYSSTSISA------SP  66
Manesc_Manes.18G075300.1        ----------------------------MAIAIDGAFDELDFSGYGSISTT-----TTPT  27
Manesc_Manes.02G161100.1        RLVLGWKSRRLLSASIWTSPSDSDLQIIMAMAIDGAL-ELDFSGYSSTATNT---TTTTT  116
LOC_Os12g06540.1                LLIPFSTQFEEISSS---------------------------------------------  24
LOC_Os11g06180.1                ------------------------------------------------------------  0
Orysat_LOC_Os03g15680.1         ----------------------------MEVTMEDVAGDFEFSGCGSTTTTS------SA  26
PGSC0003DMP400021345(nsp2)      ----------------------------MAMMVDETISDF--DCYGSLSTPTTTITTTTT  30
Traes_4AS_19FA06316.1(nsp2)     ----------------------------MDVTMEDVVGDLEISGYSS--IST------SP  24
Vigung_Vigun08g091300.1         --------------------MASLLSSSPIGAVMDDPDFLDFSNRSIT-----------T  29
Vigung_Vigun09g168400.1         ------------------------MEIDMDPD-MDVIHNLHFSRH--------------T  21
Vigung_Vigun09g168500.1         ------------------------MEIDMDTD-MDAIHNLHFSRYTTIT---------DT  26
Zeamay_Zm00008a001015           ----------------------------MEVTMDDVAGDLEFSGCSSTTTSP------S-  25
```

FIG. 27B

```
MtNSP2_Medtr3g072710.1          TPTSDEDYG--CTW-NHWSPIVNWDTFT---------GAP----DDFHHLMDTIIEDRTT  66
Glymax_Glyma.13G081700.1        TLSSHEDCN--KNNNNLWSPLIDWESLN---------ACE----NDFQTLIDSVMIDNND  66
Glymax_Glyma.04G251900.1        IPSSDDDYG--CNW-NHWSPVVNWDAFT---------GAH----DDFHHLIDSIMCDSAA  62
Glymax_Glyma.06G110800.1        TPSSDDDYG--CNW-NHWSPVVNWDAFT---------GAH----DDFHQIIDSIMCDGAA  64
HORVU4Hr1G020490.28             ------------NF-FIWSPQVALHENATI-----HVDHSTDQQHD-NVFLDT-------  54
Horvul_HORVU4Hr1G061310.1       SSSLDDGMG-LYGW-NALSPVADWGMFC---------S--DDGGHDLHGLIESMLCDDTL  113
Manesc_Manes.18G075300.1        TSAENDHHA--CNW-NDFSPVVDWEALS---------CHH----DDFHDLIESMMEDGGF  71
Manesc_Manes.02G161100.1        TSTENDQHD--GNW-NGWSPVVDWEALS---------AHH----DDFQDLIESMMDDGGL  160
LOC_Os12g06540.1                ------------SL-LLWSPQAEENPHENANMYEFDADHSHDQIHQDHQFLDMMVIQESA  71
LOC_Os11g06180.1                ------------------------------------------------------------  0
Orysat_LOC_Os03g15680.1         -SSLDDGTGMCYAW-GELSPVADWANFC---------CSDDDGGHDLHGLIESMLCDDTL  75
PGSC0003DMP400021345(nsp2)      SSSSEDDHG--CTW-NDWSPVFDWDAFS---------G-G----DNFQDLIESMIQGSGN  73
Traes_4AS_19FA06316.1(nsp2)     SSSLDDGMG-LYGW-NALSPVADWGLFS---------S--DDGGHDLHGLIESMLCDDAL  71
Vigung_Vigun08g091300.1         SSSSEED------WTNMWSPLVDWGSLA---------AGE----DNFQTLIDSIVHEE-D  69
Vigung_Vigun09g168400.1         TPSSDDDYG--CNW-NHWSPLVNWDAFT---------GSH----DDFHNLIDSIVSDGPA  65
Vigung_Vigun09g168500.1         APSSDDDYG--CNW-NHWSPLVNWDAFT---------GSH----DDFHHLIDSIVSEGPA  70
Zeamay_Zm00008a001015           SPSLDDGMG-MYAW-NALSPVTDWGSLC---------P--DDGAQDLHGLIESMLYDDTL  72
```

FIG. 27C

```
MtNSP2_Medtr3g072710.1          VLEQL-S-----------------------------------PSI----T----------  76
Glymax_Glyma.13G081700.1        DV---LT-----------------------------------PEE----S----------  74
Glymax_Glyma.04G251900.1        AEEDNLS-----------------------------------PDD----H----------  73
Glymax_Glyma.06G110800.1        PEEDNLS-----------------------------------PDD----H----------  75
HORVU4Hr1G020490.28             ---------------------AAQH-YANDWQQ---------------------------  65
Horvul_HORVU4Hr1G061310.1       IGTPEPDE-----------------------------H--PDPAM-FTDG----------  131
Manesc_Manes.18G075300.1        SQPICNS-----------------------------------------------------  78
Manesc_Manes.02G161100.1        NQTTCNS-----------------------------------------------------  167
LOC_Os12g06540.1                NEFDGNHSHDQIHQDHEFLETMVIQESANEFDGDHSHDQIHQDHEFLEMMAIQESANDLL  131
LOC_Os11g06180.1                ----------------------MVL-DSNELHQ---------------------------  10
Orysat_LOC_Os03g15680.1         VGVDDDGQ-----------------------------AGLHHADMFRDDL----------  96
PGSC0003DMP400021345(nsp2)      CF----H-----------------------------------------------------  76
Traes_4AS_19FA06316.1(nsp2)     IGKPDE-----------------------------------HPTM-FTDG----------  85
Vigung_Vigun08g091300.1         VV---LT-----------------------------------PDQ----T----------  77
Vigung_Vigun09g168400.1         ---EYPS-----------------------------------PDD----H----------  73
Vigung_Vigun09g168500.1         ---EYPS-----------------------------------PQD----H----------  78
Zeamay_Zm00008a001015           LGSAD-----------------------------------LNPAMFPDDV----------  87
```

FIG. 27D

```
MtNSP2_Medtr3g072710.1        ------TTTTTT--TTTDEEEEEMETTTTTTTTAIKTHEVGDDSKGLKLVHLLMAGAEAL  128
Glymax_Glyma.13G081700.1      -------DQSA--------------------AEESESDSTGGDERGLRLLHLLMAAAEAL  107
Glymax_Glyma.04G251900.1      ------AASNSPSASVTEEED----------DDADEETGPVDDSKGLRVVHLLMAAAEAL  117
Glymax_Glyma.06G110800.1      ------VASNSPSVSITEEDD----------DAG-------DDSKGLRLVHLLMAAAEAL  112
HORVU4Hr1G020490.28           --------QDASDVGVFTYCGE--RILGQES--GNLVAIQEELMEENSLTDLLLTGAEAV  113
Horvul_HORVU4Hr1G061310.1     ---PCYSNGSDPSSTTTTNP-------GTPVQHDDDLPQDCNPEKGLRLLHLLMAAAEAL  181
Manesc_Manes.18G075300.1      -------NSNSFSSDTMLV----------------DEETNGEDFKGLRLVHLLMAAAEAL  115
Manesc_Manes.02G161100.1      -------N--SLSTDTMMV----------------DDETSSEDFKGLRLVHLLMAAAEAL  202
LOC_Os12g06540.1              QLQDDFSVPNADPLAASFEFDERLAVAGHEN--GNVVATQ-----EESAGDLLLAGAMAV  184
LOC_Os11g06180.1              --------HDAPDVDVSINCDD--RIFGQES--VNLAAIQEELLEEDSLSDLLLAGAEAV  58
Orysat_LOC_Os03g15680.1       ---YCYGNGSNPSSTTTTNP-------GSPVFDDP---TQGCPEKGLRLLHLLMAAAEAL  143
PGSC0003DMP400021345(nsp2)    -------NSEEDSAEIMEEEEE--------EESGDSNNNQSEDINGLKLVHLLMAAAEAL  121
Traes_4AS_19FA06316.1(nsp2)   ---PCYSNASEPSSTTTTNP-------GTPVQHDDT--PDCNPEKGLRLLHLLMAAAEAL  133
Vigung_Vigun08g091300.1       ------T--------------------------PQDSDLSSHDEKGLRLVHLLMAAAEAL  105
Vigung_Vigun09g168400.1       ------AASNSPSASITEQDD------------EDEETAAADDSKGLRLVHLLMAAAEAL  115
Vigung_Vigun09g168500.1       ------AASNSPSASITEEDD------------AEEETASADDSKGLRLVHLLMAAAEAL  120
Zeamay_Zm00008a001015         ---YCCSNGSAPSSTTTTNP-------GTPVNDGDA-QKGDCHEKGLRLLHLLMAAAEAL  136
                                                                                .**::.* *:
```

FIG. 27E

```
MtNSP2_Medtr3g072710.1         TGSTKNRDLARVILIRLKELVSQH------ANGSNMERLAAHFTEALHGLLEGAGGAHNN 182
Glymax_Glyma.13G081700.1       SSGTESHDLARAILVRLNELVSP-------TQGTNIERLAAHFSHALHSLLNGTASAHT- 159
Glymax_Glyma.04G251900.1       TGAPKSRDLARVILVRLKELVSHAAP----PHGSNMERLAAYFTDALQGLLEGASGGAHN 173
Glymax_Glyma.06G110800.1       SGAPKSRDLARVILVRLKELVSSHAA----PHGSTMERLAAYFTDALQGLLEGAGGAHNN 168
HORVU4Hr1G020490.28            EAGD--PRFALAVFSRLDGLLLGTPE---NAAAGSFDRLAYHFSQGLRSRISSASTSCSP 168
Horvul_HORVU4Hr1G061310.1      SGPHKSRELARVILVRLKEMVSST-S--GNAAASNMERLAAHFTDALQGLLDGSHSVAGT 238
Manesc_Manes.18G075300.1       TGVNKSRDLARVILIRLKELVSH-------NDGTNMERLAAYFTDALQGLLEGAGGGSHG 168
Manesc_Manes.02G161100.1       TGVNKSRDLARVILVRLKELVSP-------NDGTNMERLAAYFTDALQGLLEGAGGG-HG 254
LOC_Os12g06540.1               DAGD--AVHASAIMSRLDDLLADIAGRRSCEATSPVDHLAYYFARGLKLRISGAATPASS 242
LOC_Os11g06180.1               EAGD--SILASVAFSRLDDFLSGIPE---NGAASSFDRLAYHFDQGLRSRMSSASTGCYQ 113
Orysat_LOC_Os03g15680.1        SGPHKSRELARVILVRLKEMVSHTAS--ANAAASNMERLAAHFTDALQGLLDGSHPVGGS 201
PGSC0003DMP400021345(nsp2)     TGVNKSRELARVILVRLKELASP-------NGATNMERLAAHFTDALQALLDGAASGTLH 174
Traes_4AS_19FA06316.1(nsp2)    SGPHKSRELARVILVRLKEMVSST-S--GNAGASNMERLAAHFTDALQGLLDGSHSVAGT 190
Vigung_Vigun08g091300.1        TPGTESHYLARVILVRLNELVSP-------THGTNIERLAAHFGSALQNLLDGTGSAHSI 158
Vigung_Vigun09g168400.1        TGTTKSRELARVILVRLKDLVSHA------SHGSNMERLAAYFTDALRGLLEGAGGAHNH 169
Vigung_Vigun09g168500.1        TGAAKSRELARVILVRLKDLVSHA------SHGSNMERLAAYFTDALRGLLEGAGGAHNH 174
Zeamay_Zm00008a001015          SGPQKSRELARVILVRLKQMVSHI-G--DNAAVSNMERLATHFTDALQGLLDGSHPVGGA 193
                                        * . : **. :               .::** :*  .*:  :..:
```

FIG. 27F

```
MtNSP2_Medtr3g072710.1          HHHHNNNKHYLTTNG---------PHDNQNDTLAAFQLLQDMSPYVKFGHFTANQAIIEA 233
Glymax_Glyma.13G081700.1        ---------------------------PPIDTLTAFQLLQDMSPYIKFAHFTANQAILEA 192
Glymax_Glyma.04G251900.1        NKRHHHYNIITSSCGPHH-RDD--HHNHQSNTLAAFQLLQDMSPYVKFGHFTANQAILES 230
Glymax_Glyma.06G110800.1        NNKHHHHY--ITSCGPHHHHRD--DHHHQNDTLAAFQLLQDMSPYVKFGHFTANQAILEA 224
HORVU4Hr1G020490.28             P-----------------------EP-LASDRMSVQQIIQELSPFAKFAHFTANQAILDA 204
Horvul_HORVU4Hr1G061310.1       SRQA----------------ASH--HHSTGDVLTAFQMLQDMSPYMKFGHFTANQAILEA 280
Manesc_Manes.18G075300.1        KHLIN------NGPYHHHHRD---DHHHQADVLAAFQLLQDMSPYVKFGHFTANQAILEA 219
Manesc_Manes.02G161100.1        KNSIN------NGPYHHHHRD---DHHHQEDILAAFQLLQDMSPYLKFGHFTANQAILEA 305
LOC_Os12g06540.1                P-----------------------PPPAANWSSPAYRMLQELTPFVKFAHFTANQAILEA 279
LOC_Os11g06180.1                P-----------------------EP-LPSGNMLVHQIIQELSPFVKFAHFTTNQAILDA 149
Orysat_LOC_Os03g15680.1         GRQA-------------AAAASH--H-HAGDVLTAFQMLQDMSPYMKFGHFTANQAILEA 245
PGSC0003DMP400021345(nsp2)      AKLMF------SPN-----YK---DEHHQGDVLAAFQLLQDMSPFVKFGHFTANQAIFES 220
Traes_4AS_19FA06316.1(nsp2)     SRQA-------------AMAASH--HHSTGDVLTAFQMLQDMSPYMKFGHFTANQAILEA 235
Vigung_Vigun08g091300.1         TT----------------------DAPNPTDTLTAFHLLQDMSPYVKFAHFTANQAILEA 196
Vigung_Vigun09g168400.1         SK--HHYNITY---GSHHPRDDHHHHHHQNDTLAAFQLLQDMSPYVKFGHFTANQAILET 224
Vigung_Vigun09g168500.1         SK--HHYNITY---GSHHPRDDH-HHHHQNDTLAAFQLLQDMSPYIKFGHFTANQAILEA 228
Zeamay_Zm00008a001015           GKQA-------------AAAASHGHQQHTGDVLTAFQMLQDMSPYMKFGHFTANQAILEA 240
                                                                   . :::*:::*: **.***:****:::
```

FIG. 27G

```
MtNSP2_Medtr3g072710.1        VAHERRVHVIDYDIMEGVQWASLIQSLASNNN---GPHLRITALSRTG---------TGR  281
Glymax_Glyma.13G081700.1      VAHEKRVHIIDYDITEGAQWASLIQALSS--AGPPGPHLRITALSRGGGGGGNSSSASGQ  250
Glymax_Glyma.04G251900.1      VAHERRVHIVDYDIMEGVQWASLMQALASNKTGPPGPHLRITALSRTG---------SGR  281
Glymax_Glyma.06G110800.1      VAHDRRVHIVDYDIMEGVQWASLIQALASNKTGPPGPHLRITALSRTG---------SGR  275
HORVU4Hr1G020490.28           TKGDAHVHVVDLNIGEGIQWPSLMSDLARHG----GISFHLTAVTADADYS---------  251
Horvul_HORVU4Hr1G061310.1     VAGDRRVHIVDYDLAEGIQWASLMQAMTSRPDGVSPPHLRITAITRSGGGGA--------  332
Manesc_Manes.18G075300.1      VAQDKRIHIVDYDIMEGIQWASLMQSLASRKDGPPTPHLRITALSRSG---------SGR  270
Manesc_Manes.02G161100.1      VAQDRRIHIVDYDIMEGIQWASLMQSLVSRTDGPPTPHLRITALSRSG---------SGK  356
LOC_Os12g06540.1              TADDLDVHVVDFNVGEGVQWSSLMLKLLL-------------------------------  308
LOC_Os11g06180.1              IIGDMDVHVVDLNIGEGIQWSSLMSDLARCG----GKSFRLTAITTYADCH---------  196
Orysat_LOC_Os03g15680.1       VSGDRRVHIVDYDIAEGIQWASLMQAMTSRADGVPAPHLRITAVSRSGGGGA--------  297
PGSC0003DMP400021345(nsp2)    VTHDRRVHIVDYDIMEGIQWASLMQALVSRKDGPPTPHLRITALSRSG---------SGR  271
Traes_4AS_19FA06316.1(nsp2)   VAGDRRVHIVDYDLAEGIQWASLMQAMTSRPDGVSPPHLRITAITRSGGGGA--------  287
Vigung_Vigun08g091300.1       VAHEKRVHIVDFDVTEGAQWASLMQSLSSRSTGPTAPHLRITALSRGSA--------SGR  248
Vigung_Vigun09g168400.1       VAHERRVHIVDYDIMEGVQWASLMQALASDKTGPPGPHLRITALSRTG---------TGR  275
Vigung_Vigun09g168500.1       VVHERRVHIVDYDIMEGVQWASLMQALASDKTGPPGPHLRITALSRTG---------TGR  279
Zeamay_Zm00008a001015         VAGERRVHVVDYDIAEGVQWASLMQAMTSRPDGVPPPHLRITAVSRGGGGSA--------  292
                                 :  :*::* :: ** ** **:  :
```

FIG. 27H

```
MtNSP2_Medtr3g072710.1        RSIATVQETGRRLTSFAASLGQPFSFHHCRLDSDETFRPSALKLVRGEALVFNCMLNLPH  341
Glymax_Glyma.13G081700.1      RSTASVQETGRRLTAFAASVGQPFSFHHSRLDPDETFRPSNLKLVRGEALVFNCMLHLPH  310
Glymax_Glyma.04G251900.1      RSIATVQETGRRLTAFAASLGQPFSFHHCRLDPDETFKPSSLKLVRGEALVFNCMLNLPH  341
Glymax_Glyma.06G110800.1      RSIATVQETGRRLAAFAASLGQPFSFHHCRLEPDETFKPSSLKLVRGEALVFNCMLNLPH  335
HORVU4Hr1G020490.28           --DAVHHASARWLSEFAESLNLPFQYSSLCLHSDEDLHEFS-KNSKGS-VIFSCDTT---  304
Horvul_HORVU4Hr1G061310.1     ---RAVQEAGRRLAAFAGSIGQPFSFGHCRLDSDERFRPATVRMVKGETLVANCILHQAA  389
Manesc_Manes.18G075300.1      RSIGTVQETGRRLVAFAASIGQPFSFHQCRLDSDETFRPSALKLVRGEALVINCMLHLPH  330
Manesc_Manes.02G161100.1      KSIGTVQETGRRLVAFAASIGLPFSFHQCRLDSDENFRPNALKLVRGEALVINCMLQLPH  416
LOC_Os12g06540.1              ------------------------------------------------------------  308
LOC_Os11g06180.1              --ASTHDTVVRLLSEFADSLELPFQYNSICVHNEDELHAFF-EDCKGS-VIVSCDTT---  249
Orysat_LOC_Os03g15680.1       ---RAVQEAGRRLSAFAASIGQPFSFGQCRLDSDERFRPATVRMVKGEALVANCVLHQAA  354
PGSC0003DMP400021345(nsp2)    RSFGTVQETGRRLTAFATSIGQPFSFHHCRLDSDEIFKPTNLKLVRGEALIINCMLHLPH  331
Traes_4AS_19FA06316.1(nsp2)   ---RAVQEAGRRLAAFAGSIGQPFSFGHCRLDSDERFRPATVRMVKGETLVANCILHQAA  344
Vigung_Vigun08g091300.1       RSIATVQETGRRLTAFAASVGQPFSFHQCRLDHGETFRPSSLKLIRGEALVFNCMLHLPH  308
Vigung_Vigun09g168400.1       RSITTVQETGRRLTAFAASLGQPFTFHQCRLDPDETFKPSSLKLVRGEALVLNCMLNLPH  335
Vigung_Vigun09g168500.1       RSIATVQETGRRLTAFAASLGQPFTFHQCRLDPDETFKPSSLKLVRGEALVLNCMLNLPH  339
Zeamay_Zm00008a001015         ---RAVQEAGRRLAAFAASVGQPFSFGQCRLDSDERFRPATVRMVKGETLVANCVLNQAA  349
```

FIG. 27I

```
MtNSP2_Medtr3g072710.1             L---SYRAPESVAS-FLNGAKTLNPKLVTLVEEEVGSV----------I--GGFVERFMD  385
Glymax_Glyma.13G081700.1           L---NFRASGSVGS-FLRGAKELNSRLVVLVEEEMGCV----------AADSGFVGFFMD  356
Glymax_Glyma.04G251900.1           L---SYRAPDSVAS-FLSGAKALKPRLVTLVEEEVGSS----------A--GGFVGRFME  385
Glymax_Glyma.06G110800.1           L---SYRAPESVAS-FLSGAKALKPRLVTLVEEEVASI----------V--GGFVARFMD  379
HORVU4Hr1G020490.28                --SMPYKLLSKLPALLPACVELLQPKLMVIIEEELVRIGKEVS-L----CKASFVDFFFE  357
Horvul_HORVU4Hr1G061310.1          ATTTVRRPTGSVAS-FLTGMASLGAKVVTVVEEEGEAEKNEE--EASDAAAGGFVGRFME  446
Manesc_Manes.18G075300.1           F---SYRAPDSVAS-FLSGSKTLNPRLLTLVEEEVGPI----------GD-GGFVGRFMD  375
Manesc_Manes.02G161100.1           F---SYRAPDSITS-FLSGAKTLNPRLVTLVEEEVGSI----------GD-GGFVSRFIN  461
LOC_Os12g06540.1                   ----------------LGTITILQPKLVILIEDELSRISKNPP-SPSLAAPPPFPEFFSD  351
LOC_Os11g06180.1                   --SMYYKSLSTLQSLLLVCVKKLQPKLVVTIEEDLVRIGRGVS-P----SSASFVEFFFE  302
Orysat_LOC_Os03g15680.1            ATTTIRRPTGSVAS-FLSGMAALGAKLVTVVEEEGEAEKDDDGDSAGDAAAGGFVRQFME  413
PGSC0003DMP400021345(nsp2)         F---SYRASDSVAS-FLSGSKTLNPRLVTLVEEELRPI----------GDEEGFMGRFMD  377
Traes_4AS_19FA06316.1(nsp2)        ATTTVRRPTGSVAS-FLTGMASLGAKVVTVVEEEGEAEKNEE--EASDAAAGGFVGRFME  401
Vigung_Vigun08g091300.1            L---SFRASGSVAS-FLKGAKELNPRVVVVVEEEVA-R----------GGDAGFVGLFMD  353
Vigung_Vigun09g168400.1            L---SYRTPDSIAS-FLSGAKELKPRLVTLVEEEVGSS----------V--GGFVGRFMD  379
Vigung_Vigun09g168500.1            L---SYRAPDSIAS-FLSGAKELKPRLVTLVEEEVGSS----------V--GGFVGRFMD  383
Zeamay_Zm00008a001015              ATTTVRRPTGSVAS-FLAGMATLGAKVVTVVEEDQGHA------EKDDEGAGGFVARFME  402
                                                         *  :::  :*::                   *   * :
```

FIG. 27J

```
MtNSP2_Medtr3g072710.1         SLHHYSAVFDSLEAGFPMQNR----ARTLVERVFFGPRIAGSLGRIYRTG-GE-EERRSW  439
Glymax_Glyma.13G081700.1       SLHHYSAVFDSLEVGFPMQTW----ARALVEKVFLGPRITGSVARMYGSG-TE-EEKVSW  410
Glymax_Glyma.04G251900.1       SLHHYSAVFDSLEAGFPMQGR----ARALVERVFFGPRIVGSLGRLYRTG-E--EERGSW  438
Glymax_Glyma.06G110800.1       SLHHYSAVFDSLEAGFPMQGR----ARALVERVFLGPRIVGSLARMG--E-E--EERGSW  430
HORVU4Hr1G020490.28            ALHHFTTVFESLASCFAGGNQGV--CLRLVEREMVGPRIQDFVGQYGSVT-AEV------  408
Horvul_HORVU4Hr1G061310.1      ELHRYSAVWDSLEAGFPTQSR----VRGLVERVILAPNIAGAVSRAYRGADGE--GRRGW  500
Manesc_Manes.18G075300.1       SLHHYSAVYDSLEAGFPMQGR----ARALVERVFLGPRIAGSLARIYRAR-GD-KEGCCW  429
Manesc_Manes.02G161100.1       SLHHYSAVYDSLEASFPMQSR----ARALVERVFLGPQIAGTLARIYRAR-AN-EEGSSW  515
LOC_Os12g06540.1               AVAHFTAVMESTASCLVSYDDEAWLSLRRVGEEVVGPRVEDAVGRYGSLA-GG-------  403
LOC_Os11g06180.1               ALHHFTTVFESMASCFIGSSYEP--CLRLVEMELLGPRIQDFVVKYGSVR-VEA------  353
Orysat_LOC_Os03g15680.1        ELHRYSAVWDSLEAGFPTQSR----VRGLVERVILAPNIAGAVSRAYRGVDGE--GRCGW  467
PGSC0003DMP400021345(nsp2)     TLHHYSALYDSLEAGFPLQSR----ARALVERVFLGPRITGSLARIYRAR-GE-EERCSW  431
Traes_4AS_19FA06316.1(nsp2)    ELHRYSAVWDSLEAGFPTQSR----VRGLVERVILAPNIAGAVSRAYRGTDGE--GRRGW  455
Vigung_Vigun08g091300.1        SLQHYSAVFDSLEVGFPMQKW----ARALVERVFLGPRIANSIGLMYRSG-GE--DRGSW  406
Vigung_Vigun09g168400.1        SLHHYSAVFDSLEAGFPMQGR----ARALVERVFLGPRIVGSLARVYRTG-EEVEERGSW  434
Vigung_Vigun09g168500.1        SLHHYSAVFDSLEAGFPMQGR----ARALVERVFLGPRIVGSLARVYRTG-EEVEERGSW  438
Zeamay_Zm00008a001015          ELHRYSAVWDSLEAGFPTQSR----VRGLVERAILAPNIAGAVSRAYRAVDGDGEARAGW  458
                                : ::::: :*    :                *    ...*.: . :
```

FIG. 27K

```
MtNSP2_Medtr3g072710.1              GEWLGEVGFRGVPVSFANHCQAKLLLGLFNDGYRVEEVGVGSNKLVLDWKSRR------L  493
Glymax_Glyma.13G081700.1            GEWLGAAGFRGVPLSFANHCQANLLLGLFNDGYRVEEL--ENNRLVLGWKSRR------L  462
Glymax_Glyma.04G251900.1            GEWLGAAGFRGVPMSFANHCQAKLLIGLFNDGYRVEEL--GTNKLVLDWKSRR------L  490
Glymax_Glyma.06G110800.1            GEWLGAAGFRGVPMSFANHCQAKLLIGLFNDGYRVEEL--GSNKLVLDWKSRR------L  482
HORVU4Hr1G020490.28                 NAPVVLERYGACDLSGCNVAQARMLVGLFNRGFEIVH---EKGRLMLCWKSRP------L  459
Horvul_HORVU4Hr1G061310.1           GEWMRGSGFEMVPLSCFNHSQARLLLGLFNDGYTVEET--RPNKIVLGWKARR------L  552
Manesc_Manes.18G075300.1            VEWLGATGFKEVNISFANHCQAKLLLGLFNDGYRVEEM--GCNRLVLGWKSRR------L  481
Manesc_Manes.02G161100.1            GERLGAVGFRAANISFANHCQAKLLIGLFNDGYRVEKL--DGNRLVLGWKSRR------L  567
LOC_Os12g06540.1                    --AQMMEGLRAREVSGFSVAQGKMLAGLFGGGFGVVHQ--EKGRLALCWKSRP------L  453
LOC_Os11g06180.1                    NASEVLEGFMACELSACNIAQARMLVGLFNRVFGVVF---KKISLLMVYYISLGKNDLRE  410
Orysat_LOC_Os03g15680.1             GQWMRGSGFTAVPLSCFNHSQARLLLGLFNDGYTVEET--GPNKIVLGWKARR------L  519
PGSC0003DMP400021345(nsp2)          GEWLSGVGFCESNISFANHCQAKLLLGLFNDGYRVEEI--GTNKLVLGWKSRR------L  483
Traes_4AS_19FA06316.1(nsp2)         GEWMRGSGFEMVPLSCFNHSQARLLLGLFNDGYTVEET--RPNKIVLGWKARR------L  507
Vigung_Vigun08g091300.1             EEWLSAAGFRGVPVSFANHCQANLLLGLFNDGYRVEEL--ENNKLVLGWKSRR------L  458
Vigung_Vigun09g168400.1             GEWLGAAGLRGVPMSFANHCQAKLLLGLFNDGYRVEEL--GANKLVLDWKSRR------L  486
Vigung_Vigun09g168500.1             GEWLGAAGLRGVPMSFANHCQAKLLLGLFNDGYRVEEL--GPNKLVLDWKSRR------L  490
Zeamay_Zm00008a001015               GEWMRGNGFRAVPLSCFNHSQARLLLGLFNDGYTMEET--SPNKIVLGWKARR------L  510
                                                 :*  . .*..:* ***.  : :         : : :
```

FIG. 27L

```
MtNSP2_Medtr3g072710.1          LSASLWTCSSSDSDL---------------------------------------------  508
Glymax_Glyma.13G081700.1        LSASVWSSNS--------------------------------------------------  472
Glymax_Glyma.04G251900.1        LSASLWTQINSF------------------------------------------------  502
Glymax_Glyma.06G110800.1        LSASLWTSSSHSD-----------------------------------------------  495
HORVU4Hr1G020490.28             TSVSVWAPILKERSS---------------------------------------------  474
Horvul_HORVU4Hr1G061310.1       LSASVWAPPPLSVPSSPAEG----VCQPM-GMAP------ASGGFGRTEYDYVDSFLVEP  601
Manesc_Manes.18G075300.1        LSASIWTSPSDSDLQII-------------------------------------------  498
Manesc_Manes.02G161100.1        LSASIWTSPFDSDL----------------------------------------------  581
LOC_Os12g06540.1                ISVSLWCPK---------------------------------------------------  462
LOC_Os11g06180.1                PNKVIWSSLAAGCGSHGIVVLAFYAADKLLEFKPKGIETYIHPAVERAHFHKEDRMWQEY  470
Orysat_LOC_Os03g15680.1         MSASVWAPPPLPVPSSPPEG----VCQPVVGMAPV-----ATGGFARTEFDYIDSFLVEP  570
PGSC0003DMP400021345(nsp2)      LSASIWTTMD-IDL----------------------------------------------  496
Traes_4AS_19FA06316.1(nsp2)     LSASVWAPPPLSVPSSPADG----VCQPM-GMAP------SSGGFGRTEYDYVDSFLVEP  556
Vigung_Vigun08g091300.1         ISASVWTSNS--------------------------------------------------  468
Vigung_Vigun09g168400.1         LSASLWTSSSSSSDSH--------------------------------------------  502
Vigung_Vigun09g168500.1         LSASLWTSSSSSDSH---------------------------------------------  505
Zeamay_Zm00008a001015           LSASVWAPPPVSVPSSPTEG----AFQPV-GMSP------DSGGVGRVDFDYIDSFFVEP  559
                                 .  :*
```

FIG. 27M

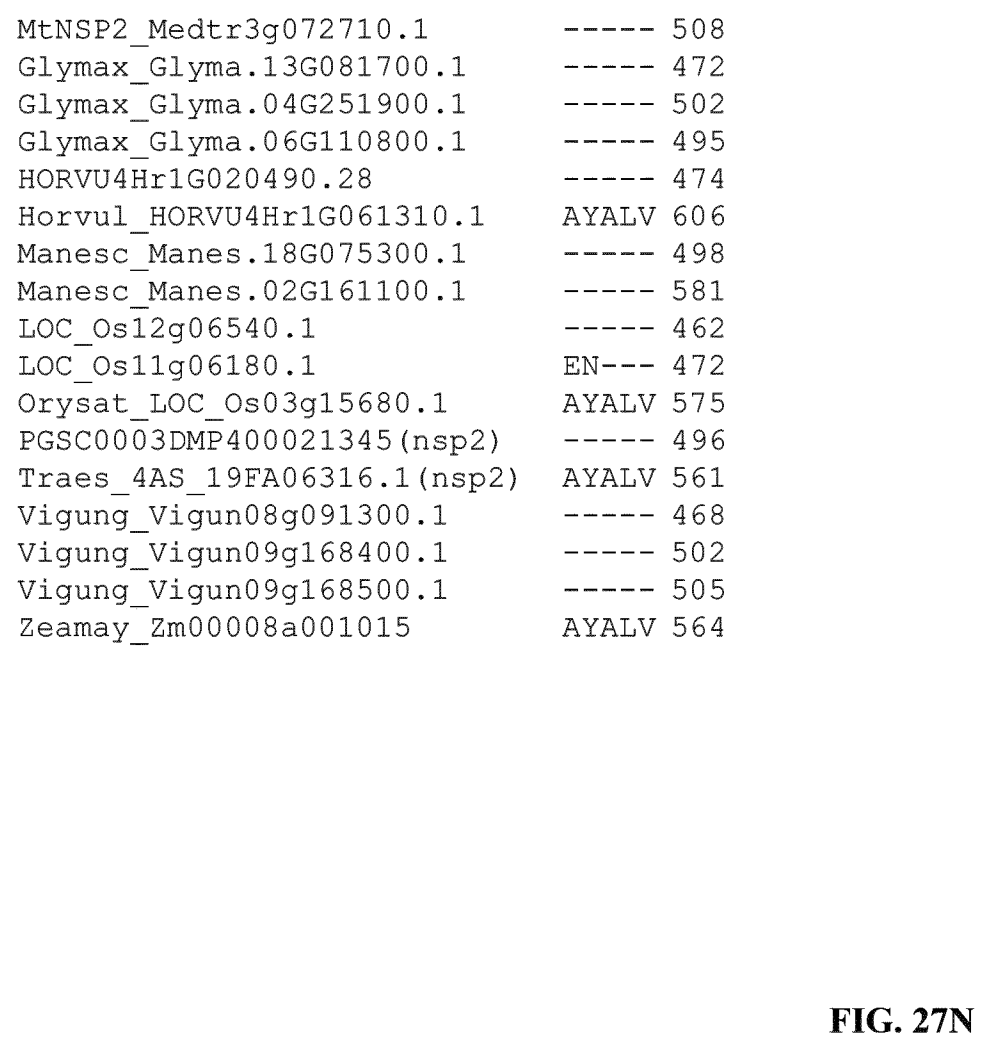

```
MtNSP2_Medtr3g072710.1          ----- 508
Glymax_Glyma.13G081700.1        ----- 472
Glymax_Glyma.04G251900.1        ----- 502
Glymax_Glyma.06G110800.1        ----- 495
HORVU4Hr1G020490.28             ----- 474
Horvul_HORVU4Hr1G061310.1       AYALV 606
Manesc_Manes.18G075300.1        ----- 498
Manesc_Manes.02G161100.1        ----- 581
LOC_Os12g06540.1                ----- 462
LOC_Os11g06180.1                EN--- 472
Orysat_LOC_Os03g15680.1         AYALV 575
PGSC0003DMP400021345(nsp2)      ----- 496
Traes_4AS_19FA06316.1(nsp2)     AYALV 561
Vigung_Vigun08g091300.1         ----- 468
Vigung_Vigun09g168400.1         ----- 502
Vigung_Vigun09g168500.1         ----- 505
Zeamay_Zm00008a001015           AYALV 564
```

FIG. 27N

```
                                           cov    pid   1 [         .         .         .
1 HvCEP1-Hordeum_vulgare                 100.0% 100.0%    MAGSKHVSSCTCCIL-IILVVSSHLATCPC
2 LOC_Os09g28780.1-Oryza_sativa           92.7%  40.2%    MAGLKLS---SCVLV-ALLFVSSHVVR-HG
3 LOC_Os08g37070.1-Oryza_sativa           89.6%  37.7%    MAGHKVV-FCTCILIFIVVVISGQ-----A
4 Zm00001e003812_P001-Zea_mays            85.4%  33.3%    MAASSKV-VCACIL--IVLVISSH-----A
5 Manes.12G100300.1-Manihot_esculenta     86.5%  24.8%    MATIRAM--CTCSLI-LVLILSHEVLV--V
  consensus/100%                                          MAs.ph....sC.l..hllhlStp.....s
  consensus/90%                                           MAs.ph....sC.l..hllhlStp.....s
  consensus/80%                                           MAu.+hs..CoChLl.llLllSuc.....s
  consensus/70%                                           MAu.+hs..CoChLl.llLllSuc.....s

                                           cov    pid             .         :         .
1 HvCEP1-Hordeum_vulgare                 100.0% 100.0%    EARRLMA-------------ASAKIDGD----
2 LOC_Os09g28780.1-Oryza_sativa           92.7%  40.2%    EARRLTA----GVA------APASKGGE----
3 LOC_Os08g37070.1-Oryza_sativa           89.6%  37.7%    EARRLAA-VANGNE------DAVAVEGDGSFR
4 Zm00001e003812_P001-Zea_mays            85.4%  33.3%    DARRLVAATCNGTEGGAC-KGGIFVQGYAGLS
5 Manes.12G100300.1-Manihot_esculenta     86.5%  24.8%    EGRRLKS---HGNK--LCKKCSARTDHR----
  consensus/100%                                          -uRRLhu.............ssh.htt.....
  consensus/90%                                           -uRRLhu.............ssh.htt.....
  consensus/80%                                           EARRLhA....Gst......susthpGc....
  consensus/70%                                           EARRLhA....Gst......susthpGc....
```

FIG. 28A

```
                                            cov    pid          .         .         .
1 HvCEP1-Hordeum_vulgare                 100.0% 100.0%     ----EACMSAGCHAVQGTASGYA-----GATW
2 LOC_Os09g28780.1-Oryza_sativa           92.7%  40.2%     EEAPQYASARGGQPAAAAGGGVT-----AASK
3 LOC_Os08g37070.1-Oryza_sativa           89.6%  37.7%     AVQETASSASTDHAAAGRGGGGAATAVQGSMP
4 Zm00001e003812_P001-Zea_mays            85.4%  33.3%     ARQKMAATATSTEQVVGGGGEG--------MP
5 Manes.12G100300.1-Manihot_esculenta     86.5%  24.8%     ----ILHVAERSQKLLGSENKT--------SK
  consensus/100%                                           .....ht.uttsp.h.uttsth..........
  consensus/90%                                            .....ht.uttsp.h.uttsth..........
  consensus/80%                                            .....hssApssptshGsuuts..........
  consensus/70%                                            .....hssApssptshGsuuts..........

                                            cov    pid          1         .         .   ] 124
1 HvCEP1-Hordeum_vulgare                 100.0% 100.0%     VATTDS-RGTAPGHSPGIGNKLHAAGNDRR
2 LOC_Os09g28780.1-Oryza_sativa           92.7%  40.2%     MASTDG-RPTSPGHSPGIGNK--ATGNVR-
3 LOC_Os08g37070.1-Oryza_sativa           89.6%  37.7%     MTTTDS-RPTAPGNSPGIGNK--GKINN--
4 Zm00001e003812_P001-Zea_mays            85.4%  33.3%     ATTTDS-RPTAPGNSPGIGNK--GKINN--
5 Manes.12G100300.1-Manihot_esculenta     86.5%  24.8%     MDYVDDFRPTVPGHSPGVGHS--LKN----
  consensus/100%                                           hs.sDs.RsTsPGpSPGlGpp..ht.....
  consensus/90%                                            hs.sDs.RsTsPGpSPGlGpp..ht.....
  consensus/80%                                            hsoTDu.RPTuPGpSPGIGNK..uphNs..
  consensus/70%                                            hsoTDu.RPTuPGpSPGIGNK..uphNs..
```

FIG. 28A (cont)

```
                                   cov    pid   1 [         .         .         .         .
1 HvCEP2-Hordeum_vulgare         100.0% 100.0%    MAGSKHASSCTCILIILL-VSSHLAP-CEARRLMAASA----
2 LOC_Os09g28780.1-Oryza_sativa   93.5%  48.5%    MAGLKLSS---CVLVALLFVSSHVVRHGEARRLTAGVAAPAS
3 Zm00001e003812_P001-Zea_mays    91.4%  34.3%    MAASSKVV-CACILIVLV-ISSH----ADARRLVAATC----
  consensus/100%                                  MAu.phss...ClLlhLl.lSSH....s-ARRLhAuss....
  consensus/90%                                   MAu.phss...ClLlhLl.lSSH....s-ARRLhAuss....
  consensus/80%                                   MAu.phss...ClLlhLl.lSSH....s-ARRLhAuss....
  consensus/70%                                   MAu.phss...ClLlhLl.lSSH....s-ARRLhAuss....

                                   cov    pid            :         .         .         . 80
1 HvCEP2-Hordeum_vulgare         100.0% 100.0%    KINGDAACE-------SSACRAAQGAAS----------
2 LOC_Os09g28780.1-Oryza_sativa   93.5%  48.5%    KGGEEEAPQ-------YASARGGQPAAAAG-------G
3 Zm00001e003812_P001-Zea_mays    91.4%  34.3%    NGTEGGACKGGIFVQGYAGLSARQKMAATATSTEQVVG
  consensus/100%                                  phstttAsp.......uuhputQ.hAu..........
  consensus/90%                                   phstttAsp.......uuhputQ.hAu..........
  consensus/80%                                   phstttAsp.......uuhputQ.hAu..........
  consensus/70%                                   phstttAsp.......uuhputQ.hAu..........

                                   cov    pid  81         .         1         .    ] 116
1 HvCEP2-Hordeum_vulgare         100.0% 100.0%    GAASTSEMASTDGRGTGQGHSPGIGNKLHASGNGRR
2 LOC_Os09g28780.1-Oryza_sativa   93.5%  48.5%    GVTAASKMASTDGRPTSPGHSPGIGNK--ATGNVR-
3 Zm00001e003812_P001-Zea_mays    91.4%  34.3%    GGEGMPATTTDSRPTAPGNSPGIGNK--GKINN--
  consensus/100%                                  Gssts..hsoTDuRsTu.GpSPGIGNK..uphNs..
  consensus/90%                                   Gssts..hsoTDuRsTu.GpSPGIGNK..uphNs..
  consensus/80%                                   Gssts..hsoTDuRsTu.GpSPGIGNK..uphNs..
  consensus/70%                                   Gssts..hsoTDuRsTu.GpSPGIGNK..uphNs..
```

FIG. 28B

```
                                            cov    pid   1 [        .         .         .
1 HvCEP3-Hordeum_vulgare                   100.0% 100.0%   --------------------------------
2 Traes_7BL_D35EA83DB.1-Triticum_aestivum  100.0%  88.0%   --------------------------------
3 Traes_7AL_0C3298060.1-Triticum_aestivum  100.0%  86.7%   --------------------------------
4 Traes_7DL_5D114AED4.1-Triticum_aestivum  100.0%  86.7%   --------------------------------
5 Zm00001e030196_P001-Zea_mays             100.0%  38.0%   MQAAYIKRRELAQEVRQSQLCEPARVINLSTT
  consensus/100%                                           ................................
  consensus/90%                                            ................................
  consensus/80%                                            ................................
  consensus/70%                                            ................................

                                            cov    pid             .         :         .
1 HvCEP3-Hordeum_vulgare                   100.0% 100.0%   ---------------MAISSKIAVVFMLLLSTT
2 Traes_7BL_D35EA83DB.1-Triticum_aestivum  100.0%  88.0%   ---------------MAISSNTVVVFMLLLSTA
3 Traes_7AL_0C3298060.1-Triticum_aestivum  100.0%  86.7%   ---------------MAISSNTVVVFMLLLSTA
4 Traes_7DL_5D114AED4.1-Triticum_aestivum  100.0%  86.7%   ---------------MAISSNTVVVFMLLLSTA
5 Zm00001e030196_P001-Zea_mays             100.0%  38.0%   EFSPPPLPSHSKLEIMAISSKTVAVSMLLLSAV
  consensus/100%                                           ...............MAISSphssV.MLLLSss
  consensus/90%                                            ...............MAISSphssV.MLLLSss
  consensus/80%                                            ...............MAISSpTVVVFMLLLSTs
  consensus/70%                                            ...............MAISSpTVVVFMLLLSTs
```

FIG. 28C

```
                                            cov    pid          .         .         .
1 HvCEP3-Hordeum_vulgare                  100.0% 100.0%    -FMQLPVPADARRL-EVKAPILSVHR----PCTG
2 Traes_7BL_D35EA83DB.1-Triticum_aestivum 100.0%  88.0%    -FMQLPVPADARRL-EVKAPIISVRP----PCTG
3 Traes_7AL_0C3298060.1-Triticum_aestivum 100.0%  86.7%    -FMQLPVPADARRL-EVKAPIISVRP----PCTG
4 Traes_7DL_5D114AED4.1-Triticum_aestivum 100.0%  86.7%    -FMQLPVPADARRL-EVKAPIVSVRP----PCTG
5 Zm00001e030196_P001-Zea_mays            100.0%  38.0%    FFVLLSAPAHARKLGTMRAPTSSVRRPPAAPCTP
  consensus/100%                                           .Fh.LssPAcAR+L.ph+APh.SV+.....PCTs
  consensus/90%                                            .Fh.LssPAcAR+L.ph+APh.SV+.....PCTs
  consensus/80%                                            .FMQLPVPADARRL.EVKAPIlSVR.....PCTG
  consensus/70%                                            .FMQLPVPADARRL.EVKAPIlSVR.....PCTG

                                            cov    pid     1         .         .       ] 129
1 HvCEP3-Hordeum_vulgare                  100.0% 100.0%    RSTLETPPEQVES-TTPGHSPSIGHNSPPN
2 Traes_7BL_D35EA83DB.1-Triticum_aestivum 100.0%  88.0%    RSTLEAPAEQVES-TTPGHSPSIGHNSPPN
3 Traes_7AL_0C3298060.1-Triticum_aestivum 100.0%  86.7%    RGTLEAPAEQVES-TTPGHSPSIGHNSPPN
4 Traes_7DL_5D114AED4.1-Triticum_aestivum 100.0%  86.7%    RSTLGAPAEQVES-TTPGHSPSIGHNSPPN
5 Zm00001e030196_P001-Zea_mays            100.0%  38.0%    RSILQEVATQTESTTTPGHSPSIGHNSPPN
  consensus/100%                                           RuhLttsspQsES.TTPGHSPSIGHNSPPN
  consensus/90%                                            RuhLttsspQsES.TTPGHSPSIGHNSPPN
  consensus/80%                                            RSTLpsPAEQVES.TTPGHSPSIGHNSPPN
  consensus/70%                                            RSTLpsPAEQVES.TTPGHSPSIGHNSPPN
```

FIG. 28C (cont)

```
                                              cov     pid   1 [        .         .         .
1 HvCEP4-Hordeum_vulgare                   100.0% 100.0%    MASSK-VLCTCIL--IIVVSSSQAEARRLT
2 Traes_3B_148834D30.1-Triticum_aestivum 100.0%  87.9%    MARSK-VLCTCIL--IIIISSIQAEARRLT
3 LOC_Os08g37070.1-Oryza_sativa             93.9%  47.3%    MAGHKVVFCTCILIFIVVVISGQAEARRL-
4 Zm00001e003812_P001-Zea_mays              90.9%  43.2%    MAASSKVVCACIL--IVLVISSHADARRLV
  consensus/100%                                            MAtpp.VhCsCIL..Illl.S.pA-ARRL.
  consensus/90%                                             MAtpp.VhCsCIL..Illl.S.pA-ARRL.
  consensus/80%                                             MAtpp.VhCsCIL..Illl.S.pA-ARRL.
  consensus/70%                                             MAuSK.VlCTCIL..IllV.SuQAEARRLs

                                              cov     pid              .         :         .
1 HvCEP4-Hordeum_vulgare                   100.0% 100.0%    TARVAAVASKGKE-----PWGALESN---S
2 Traes_3B_148834D30.1-Triticum_aestivum 100.0%  87.9%    TATVVAVASKGKE-----PWGELEGN---S
3 LOC_Os08g37070.1-Oryza_sativa             93.9%  47.3%    -----AAVANGNE-----DAVAVEGDGSFR
4 Zm00001e003812_P001-Zea_mays              90.9%  43.2%    -----AATCNGTEGGACKGGIFVQGYAGLS
  consensus/100%                                            .....AssspGpE.....shh.lpu....p
  consensus/90%                                             .....AssspGpE.....shh.lpu....p
  consensus/80%                                             .....AssspGpE.....shh.lpu....p
  consensus/70%                                             .....AssupGpE.....shstlEGs...S
```

FIG. 28D

```
                                                  cov     pid              .         .         .
1 HvCEP4-Hordeum_vulgare                        100.0% 100.0%    RSFRATSTETSVAGAAGLDGEAMSTA----
2 Traes_3B_148834D30.1-Triticum_aestivum 100.0%  87.9%    RSLRATSSETSIAGAQGLDGEAMSTA----
3 LOC_Os08g37070.1-Oryza_sativa                  93.9%  47.3%    AVQETASSASTDHAAAGRGGGGAATAVQGS
4 Zm00001e003812_P001-Zea_mays                   90.9%  43.2%    ARQKMAATATSTEQVVGGGGEG--------
  consensus/100%                                                 t..chsuotoo.tts.GhsGtu........
  consensus/90%                                                  t..chsuotoo.tts.GhsGtu........
  consensus/80%                                                  t..chsuotoo.tts.GhsGtu........
  consensus/70%                                                  ts.+ssSotTSstuAsGhsGEuhuTA....

                                                  cov     pid              1         .      ] 117
1 HvCEP4-Hordeum_vulgare                        100.0% 100.0%    ---TTVESRGTAPGNSPGIGNKGKINN
2 Traes_3B_148834D30.1-Triticum_aestivum 100.0%  87.9%    ---TTVESRGTAPGNSPGIGNKGKINN
3 LOC_Os08g37070.1-Oryza_sativa                  93.9%  47.3%    MPMTTTDSRPTAPGNSPGIGNKGKINN
4 Zm00001e003812_P001-Zea_mays                   90.9%  43.2%    MPATTTDSRPTAPGNSPGIGNKGKINN
  consensus/100%                                                 ...TTs-SRsTAPGNSPGIGNKGKINN
  consensus/90%                                                  ...TTs-SRsTAPGNSPGIGNKGKINN
  consensus/80%                                                  ...TTs-SRsTAPGNSPGIGNKGKINN
  consensus/70%                                                  ...TTs-SRsTAPGNSPGIGNKGKINN
```

FIG. 28D (cont)

METHODS, PLANTS AND COMPOSITIONS FOR OVERCOMING NUTRIENT SUPPRESSION OF MYCORRHIZAL SYMBIOSIS

CROSS-REFERENCE TO RELATED APPLICATION

This application is a national stage application under 35 U.S.C. § 371 of International Application No. PCT/EP2021/054816, filed internationally on Feb. 26, 2021 which claims the benefit of U.S. Provisional Application No. 62/983,433, filed Feb. 28, 2020, each of which is hereby incorporated by reference in its entirety.

SUBMISSION OF SEQUENCE LISTING AS ASCII TEXT FILE

The content of the following submission on ASCII text file is incorporated herein by reference in its entirety: a computer readable form (CRF) of the Sequence Listing (file name: 794542000700SUBSEQLIST.TXT, date recorded: Feb. 9, 2023, size: 620,044).

TECHNICAL FIELD

The present disclosure relates to genetically altered plants. In particular, the present disclosure relates to genetically altered plants with increased activity of one or more of a NODULATION SIGNALING PATHWAY 1 (NSP1) protein, a NODULATION SIGNALING PATHWAY 2 (NSP2) protein, or a C-TERMINALLY ENCODED PEPTIDE (CEP peptide) that have increased mycorrhization and/or promoted symbiotic responses under high phosphate and/or high nitrate conditions. Further, the present disclosure relates to methods of cultivating plants with exogenous butenolide agents or CEP peptides that have increased mycorrhization and/or promoted symbiotic responses under high phosphate and/or high nitrate conditions, which may be in combination with the genetically altered plants of the present application.

BACKGROUND

Plant growth and development depends on carbon dioxide and sunlight above ground, and water and mineral nutrients in the soil. The accessibility of nutrients in the soil depends on many factors, and nutrient availability varies spatially and temporally. Local nutrient sensing, as well as the perception of overall nutrient status, shape the plant's response to its nutrient environment, and act to coordinate plant development with microbial engagement to optimize nutrient capture and regulate plant growth.

The principle nutrients that limit plant productivity are nitrogen (N) and phosphorus (P). In soils where these nutrients are ample, shoot biomass can exceed root biomass, because minimal root systems are able to capture sufficient nutrients. Vegetative growth is also promoted, allowing plants to accumulate resources and invest in seed production. In soils where these nutrients are limiting, overall plant growth is reduced to optimize productivity, while root systems are expanded to facilitate nutrient capture. In addition to the expansion of root systems, colonization by microorganisms is promoted, to further facilitate nutrient capture.

The mutualistic association with arbuscular mycorrhizal fungi dates to the earliest land plants, and is thought to have facilitated the transition from an aquatic to a terrestrial lifestyle (M. Parniske, Arbuscular mycorrhiza: the mother of plant root endosymbioses. *Nature Reviews Microbiology* 6, 763-775 (2008)). Because of the evolutionarily early establishment of this association, the arbuscular mycorrhizal association is both extremely widespread in the plant kingdom and intricately networked with plant nutrient capture physiology. Mutualistic mycorrhizal associations increase the surface area for nitrogen and phosphorus capture and make additional nutrients in the soil more available to the plant. While these associations would seem to be uniformly beneficial to plants, studies have shown that they can have substantial energetic costs for plants (L. H. Luginbuehl et al., Fatty acids in arbuscular mycorrhizal fungi are synthesized by the host plant. *Science* 356, 1175-1178 (2017)), and so are inhibited when sufficient nutrients are present in the soil.

In high-intensity agriculture, nitrogen and phosphorus are typically applied at high concentrations in the form of inorganic fertilizers, in order to promote crop productivity. The concentrations used are generally in excess of the amounts needed by plants or the amounts able to be stored in soil, and so the nutrients are often released into the environment, where they reduce biodiversity and contribute to climate change (C. J. Stevens, Nitrogen in the environment. *Science* 363, 578-580 (2019); J. A. Foley et al., Solutions for a cultivated planet. *Nature* 478, 337-342 (2011); J. Rockstrom et al., A safe operating space for humanity. *Nature* 461, 472-475 (2009)). Similarly, the manufacture of inorganic fertilizers is costly in terms of resources and energy (W. F. Zhang et al., New technologies reduce greenhouse gas emissions from nitrogenous fertilizer in China. *Proc Natl Acad Sci USA* 110, 8375-8380 (2013)).

There exists a need for a system by which nitrogen and phosphorus can be made more available to plants across agricultural systems. Preferably, this system would function in conditions where there are high levels of nutrients (e.g., nitrogen, phosphorus) in the environment surrounding the plant roots, whether natural or due to application of fertilizers.

BRIEF SUMMARY

In order to meet these needs, the present disclosure provides methods of cultivation that increase mycorrhization and/or promote symbiotic responses under nutrient conditions that suppress mycorrhization and genetically altered plants for use of such methods, whereby the increased mycorrhization and/or promoted symbiotic responses allows the plant to obtain greater nutrients from the environment around the plant roots. The present disclosure provides genetically altered plants with increased activity of one or more of a NODULATION SIGNALING PATHWAY 1 (NSP1) protein, or a NODULATION SIGNALING PATHWAY 2 (NSP2) protein that have increased mycorrhization and/or promoted symbiotic responses under high phosphate and/or high nitrate conditions. The present disclosure further provides genetically altered plants with increased activity of a C-TERMINALLY ENCODED PEPTIDE (CEP peptide) that have increased mycorrhization and/or promoted symbiotic responses under high phosphate and/or high nitrate conditions. In addition, the present disclosure provides methods of cultivating these plants that include exogenous application of strigolactones, karrikins, and/or CEP peptides to increase mycorrhization and/or promote symbiotic responses under specific nutrient conditions.

An aspect of the disclosure includes methods of cultivating a genetically altered plant with increased mycorrhization and/or promoted symbiotic responses under conditions including a phosphate level around the plant roots that suppresses mycorrhization and/or symbiotic responses, including: (a) providing the genetically altered plant, wherein the plant or a part thereof includes one or more genetic alterations, wherein the one or more genetic alterations reduce the phosphate level suppression of mycorrhization and/or symbiotic responses; and (b) cultivating the genetically altered plant under the phosphate level around the plant roots, wherein the genetically altered plant has increased mycorrhization and/or promoted symbiotic responses as compared to a wild type (WT) plant grown under the same conditions. An additional embodiment of this aspect includes the one or more genetic alterations resulting in increased activity of one or more of a NODULATION SIGNALING PATHWAY 1 (NSP1) protein or a NODULATION SIGNALING PATHWAY 2 (NSP2) protein. Yet another embodiment of this aspect includes the increased activity being at least 10% greater, at least 20% greater, at least 30% greater, at least 40% greater, at least 50% greater, at least 75% greater, at least 100% greater, at least 150% greater, or at least 200% greater than the activity of the corresponding one or more proteins in the WT plant grown under the same conditions. A further embodiment of this aspect, which may be combined with any of the preceding embodiments that has the one or more genetic alterations resulting in increased activity, includes the increased activity being no greater than 500%, no greater than 400%, no greater than 300%, no greater than 200%, no greater than 150%, or no greater than 125% of the activity of the corresponding one or more proteins in the WT plant grown under the same conditions. Still another embodiment of this aspect, which may be combined with any of the preceding embodiments that has the one or more genetic alterations resulting in increased activity, includes the NSP1 protein including an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207. In an additional embodiment of this aspect, the NSP1 protein includes SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207. Yet another embodiment of this aspect, which may be combined with any of the preceding embodiments that has the one or more genetic alterations resulting in increased activity, includes the NSP2 protein including an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208. In a further embodiment of this aspect, the NSP2 protein includes SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208.

Yet another embodiment of this aspect, which may be combined with any of the preceding embodiments that has the one or more genetic alterations resulting in increased activity, includes one or more of the NSP1 protein and the NSP2 protein being endogenous. A further embodiment of this aspect includes increased activity of the one or more endogenous NSP1 protein and the endogenous NSP2 protein being achieved using a gene editing technique to introduce the one or more genetic alterations. Still another embodiment of this aspect includes the gene editing technique being selected from the group of transcription activator-like effector nuclease (TALEN) gene editing techniques, clustered Regularly Interspaced Short Palindromic Repeat (CRISPR/Cas) gene editing techniques, or zinc-finger nuclease (ZFN) gene editing techniques. In an additional embodiment of this aspect, which may be combined with any of the preceding embodiments that has a gene editing technique to introduce the one or more genetic alterations, the one or more genetic alterations that increase the activity of the endogenous protein are selected from the group of inactivating a repressor element that represses expression of the endogenous protein, removing a repressor element that represses expression of the endogenous protein, modulating the methylation state of a repressor element that represses expression of the endogenous protein, activating an enhancer element that increases expression of the endogenous protein, adding an enhancer element that increases expression of the endogenous protein, modulating the methylation state of an enhancer element that increases expression of the endogenous protein, adding a transcriptional activator recruiting or binding element that activates expression of the endogenous protein, replacing the endogenous promoter with an overexpression promoter that directs expression of the endogenous protein, modulating the methylation state of the endogenous promoter, modulating the methylation state of the endogenous coding sequence, adding elements that stabilize an endogenous mRNA encoding the endogenous protein, removing elements that destabilize the endogenous mRNA encoding the endogenous protein, modifying a coding sequence to increase stability of the endogenous protein, or modifying a coding sequence for the endogenous protein to increase activity of the endogenous protein.

Still another embodiment of this aspect, which may be combined with any of the preceding embodiments that has the one or more genetic alterations resulting in increased activity, includes the increased activity being due to heterologous expression of one or more of the NSP1 protein and the NSP2 protein. A further embodiment of this aspect includes increased activity of the one or more of the heterologous NSP1 protein and the heterologous NSP2 protein being achieved using a vector including a first nucleic acid encoding the heterologous protein operably linked to a second nucleic acid encoding a promoter. An additional embodiment of this aspect includes the promoter being selected from the group of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, or any combination thereof.

In yet another embodiment of this aspect, which may be combined with any of the preceding embodiments, the phosphate level around the plant roots completely suppresses mycorrhization and/or symbiotic responses in the WT plant grown under the same conditions. In still another embodiment of this aspect, which may be combined with any of the preceding embodiments, the nitrogen level around the plant roots is permissive of mycorrhization and/or symbiotic responses in the WT plant grown under the same conditions. In an additional embodiment of this aspect, the nitrogen around the plant roots is present in the form of nitrate, and wherein the nitrate level around the plant roots is less than 2.5 mM, less than 2 mM, less than 1.5 mM, less than 1 mM, less than 0.75 mM, less than 0.5 mM, or less than 0.25 mM. In a further embodiment of this aspect, which may be combined with any of the preceding embodiments, the phosphate level around the plant roots includes at least 100 μM phosphate, at least 200 μM phosphate, at least 300 μM phosphate, at least 400 μM phosphate, at least 500 μM phosphate, at least 600 μM phosphate, at least 800 μM phosphate, at least 1000 μM phosphate, at least 2000 μM phosphate, at least 3000 μM phosphate, at least 3750 μM phosphate, at least 4000 μM phosphate, or at least 5000 μM phosphate. In an additional embodiment of this aspect, which may be combined with any of the preceding embodiments, the plant is barley, maize, rice, wheat, another cereal crop, cassava, potato, soy, or a legume crop. Yet another embodiment of this aspect includes the plant being barley.

In a further embodiment of this aspect, which may be combined with any of the preceding embodiments, the mycorrhization includes a symbiotic association of one or more plant parts selected from the group of a root system, a root, a root primordia, a root tip, a lateral root, a root meristem, or a root cell, with mycorrhizal fungi. An additional embodiment of this aspect includes the mycorrhizal fungi being selected from the group of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, or any combination thereof. In still another embodiment of this aspect, which may be combined with any of the preceding embodiments, increased mycorrhization enhances plant uptake of nutrients surround the plant roots selected from the group of phosphate, nitrate, or potassium, and increased mycorrhization optionally enhances plant uptake of water.

Yet another embodiment of this aspect, which may be combined with any of the preceding embodiments that does not have the nitrogen level around the plant roots being permissive of mycorrhization and/or symbiotic responses, further includes cultivating the genetically altered plant under conditions including a nitrogen level around the plant roots that suppresses mycorrhization and/or symbiotic responses, wherein the genetically altered plant of step a) further includes one or more genetic alterations that reduce the nitrogen level suppression of mycorrhization and/or symbiotic responses, and wherein step b) further includes cultivating the genetically altered plant under the nitrogen level around the plant roots, wherein the genetically altered plant has increased mycorrhization and/or promoted symbiotic responses as compared to a WT plant grown under the same conditions. In a further embodiment of this aspect, the one or more genetic alterations result in increased activity of a C-TERMINALLY ENCODED PEPTIDE (CEP peptide). In still another embodiment of this aspect, the increased activity is at least 10% greater, at least 20% greater, at least 30% greater, at least 40% greater, at least 50% greater, at least 75% greater, at least 100% greater, at least 150% greater, or at least 200% greater than the activity of the corresponding one or more proteins in the WT plant grown under the same conditions. In yet another embodiment of this aspect, which may be combined with any of the preceding embodiments that has the one or more genetic alterations resulting in increased activity of a CEP peptide, the increased activity is no greater than 500%, no greater than 400%, no greater than 300%, no greater than 200%, no greater than 150%, or no greater than 125% of the activity of the corresponding one or more proteins in the WT plant grown under the same conditions. In an additional embodiment of this aspect, which may be combined with any of the preceding embodiments that has the one or more genetic alterations resulting in increased activity of a CEP peptide, the CEP peptide includes an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23. In a further embodiment of this aspect, the CEP peptide includes SEQ ID NO: 17, SEQ ID NO: 18, SEQ ID NO: 19, SEQ ID NO: 20, SEQ ID NO: 21, SEQ ID NO: 22, or SEQ ID NO: 23. In still another embodiment of this aspect, which may be combined with any of the preceding embodiments that has the one or more genetic alterations resulting in increased activity of a CEP peptide, the CEP peptide is endogenous. Yet another embodiment of this aspect includes increased activity of the endogenous CEP peptide being achieved using a gene editing technique to introduce the one or more genetic alterations. An additional embodiment of this aspect includes the gene editing technique being selected from the group of transcription activator-like effector nuclease (TALEN) gene editing techniques, clustered Regularly Interspaced Short Palindromic Repeat (CRISPR/Cas) gene editing techniques, or zinc-finger nuclease (ZFN) gene editing techniques. In a further embodiment of this aspect, which may be combined with any of the preceding aspects that has a gene editing technique to introduce the one or more genetic alterations, the one or more genetic alterations that increase the activity of the endogenous protein are selected from the group of inactivating a repressor element that represses expression of the endogenous protein, removing a repressor element that represses expression of the endogenous protein, modulating the methylation state of a repressor element that represses expression of the endogenous protein, activating an enhancer element that increases expression of the endogenous protein, adding an enhancer element that increases expression of the endogenous protein, modulating the methylation state of an enhancer element that increases expression of the endogenous protein, adding a transcriptional activator recruiting or binding element that activates expression of the endogenous protein, replacing the endogenous promoter with an overexpression promoter that directs expression of the endogenous protein, modulating the methylation state of the endogenous promoter; modulating the methylation state of the endogenous coding sequence, adding elements that stabilize an endogenous mRNA encoding the endogenous protein, removing elements that destabilize the endogenous mRNA encoding the endogenous protein, modifying a coding sequence to increase stability of the endogenous protein, or modifying a coding sequence for the endogenous protein to increase activity of the endogenous protein. In still another embodiment of this aspect, which may be combined with any of the preceding embodiments that has the one or more genetic alterations resulting in increased activity of a CEP peptide, the increased activity is due to heterologous expression of the CEP peptide. An additional embodiment of this aspect includes increased activity of the heterologous CEP peptide being achieved using a vector including a first nucleic acid encoding the heterologous protein operably linked to a second nucleic acid encoding a promoter. A further embodiment of this aspect includes the promoter being selected from the group of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, or any combination thereof.

Yet another embodiment of this aspect, which may be combined with any of the preceding embodiments that does not have the nitrogen level around the plant roots being permissive of mycorrhization and/or symbiotic responses, further includes cultivating the genetically altered plant under conditions including a nitrogen level around the plant roots that suppresses mycorrhization and/or symbiotic responses, wherein step a) further includes cultivating the plant under conditions including the nitrogen level around the plant roots, and wherein step b) further includes exposing the plant or a part thereof to an effective amount of a CEP peptide, wherein the effective amount of the CEP peptide increases mycorrhization and/or promotes symbiotic responses in the plant or plant part as compared to the plant grown under the same conditions without the CEP peptide. In still another embodiment of this aspect, the effective amount of the CEP peptide includes at least 0.1 μM CEP peptide, at least 0.25 μM CEP peptide, at least 0.5 μM CEP peptide, at least 0.75 μM CEP peptide, at least 1 μM CEP peptide, at least 1.25 μM CEP peptide, at least 1.5 μM CEP peptide, at least 1.75 μM CEP peptide, or at least 2 μM CEP peptide. Further embodiments of this aspect, which may be combined with any of the preceding embodiments that have the plant or a part thereof being exposed to a CEP peptide, include the plant or the part thereof being exposed to the CEP peptide by direct application, application through irrigation or spraying, application in a seed coating, application in a seed coating with a mycorrhizal inoculum, or any combination thereof. In additional embodiments of this aspect, which may be combined with any of the preceding embodiments that have the plant or a part thereof being exposed to a CEP peptide, the CEP peptide includes an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23. In yet another embodiment of this aspect, the CEP peptide includes SEQ ID NO: 17, SEQ ID NO: 18, SEQ ID NO: 19, SEQ ID NO: 20, SEQ ID NO: 21, SEQ ID NO: 22, or SEQ ID NO: 23. In still another embodiment of this aspect, which may be combined with any of the preceding embodiments that does not have the nitrogen level around the plant roots being permissive of mycorrhization and/or symbiotic responses, the nitrogen level around the plant roots completely suppresses mycorrhization and/or symbiotic responses in the WT plant grown under the same conditions. An additional embodiment of this aspect includes the nitrogen around the plant roots being present in the form of nitrate, and the nitrate level around the plant roots being greater than 2.75 mM, greater than 3 mM, greater than 3.25 mM, greater than 3.5 mM, greater than 3.75 mM, greater than 4 mM, greater than 4.25 mM, greater than 4.5 mM, greater than 4.75 mM, greater than 5 mM, or greater than 5.5 mM.

An additional aspect of the disclosure includes methods of cultivating a plant with increased mycorrhization and/or promoted symbiotic responses under conditions including a phosphate level around the plant roots that suppresses mycorrhization and/or symbiotic responses, including: (a) cultivating the plant under conditions including the phosphate level around the plant roots; and (b) exposing the plant or a part thereof to an effective amount of a butenolide agent, wherein the effective amount of the butenolide agent increases mycorrhization and/or promotes symbiotic responses in the plant or plant part as compared to the plant grown under the same conditions without the butenolide agent. In yet another embodiment of this aspect, the effective amount of the butenolide agent includes at least 0.1 μM butenolide agent, at least 0.25 μM butenolide agent, at least 0.5 μM butenolide agent, at least 0.75 μM butenolide agent, at least 1 μM butenolide agent, at least 1.25 μM butenolide agent, at least 1.5 μM butenolide agent, at least 1.75 μM butenolide agent, or at least 2 μM butenolide agent. A further embodiment of this aspect, which may be combined with any of the preceding embodiments, includes the plant or the part thereof being exposed to the butenolide agent by direct application, application through irrigation or spraying, application in a seed coating, application in a seed coating with a mycorrhizal inoculum, or any combination thereof. Yet another embodiment of this aspect, which may be combined with any of the preceding embodiments, includes the butenolide agent being a strigolactone. Still another embodiment of this aspect includes the strigolactone being selected from the group of 5-deoxystrigol, strigol, sorgomol, sorgolactone, other strigol-like compounds, 4-deoxyorobanchol, orobanchol, fabacyl acetate, solanocol, other orobanchol-like compounds, GR24, or any combination thereof. An additional embodiment of this aspect, which may be combined with any of the preceding embodiments that has a butenolide agent, includes the butenolide agent being a karrikin. Yet another embodiment of this aspect includes the karrikin being selected from the group of karrikin1, karrikin2, karrikin3, karrikin4, karrikin5, karrikin6, a mixture of karrikin1 and karrikin2, GR24, karrikin contained in liquid smoke, or any combination thereof.

Still another embodiment of this aspect, which may be combined with any of the preceding embodiments, includes the phosphate level around the plant roots completely suppressing mycorrhization and/or symbiotic responses in the plant grown under the same conditions without the butenolide agent. In a further embodiment of this aspect, which may be combined with any of the preceding embodiments, the nitrogen level around the plant roots is permissive of mycorrhization and/or symbiotic responses in the plant grown under the same conditions without the butenolide agent. In yet another embodiment of this aspect, the nitrogen around the plant roots is present in the form of nitrate, and the nitrate level around the plant roots is less than 2.5 mM, less than 2 mM, less than 1.5 mM, less than 1 mM, less than 0.75 mM, less than 0.5 mM, or less than 0.25 mM. In an additional embodiment of this aspect, which may be combined with any of the preceding embodiments, the phosphate level around the plant roots includes at least 100 μM phosphate, at least 200 μM phosphate, at least 300 μM phosphate, at least 400 μM phosphate, at least 500 μM phosphate, at least 600 μM phosphate, at least 800 μM phosphate, at least 1000 μM phosphate, at least 2000 μM phosphate, at least 3000 μM phosphate, at least 3750 μM phosphate, at least 4000 μM phosphate, or at least 5000 μM phosphate. In yet another embodiment of this aspect, which may be combined with any of the preceding embodiments, the plant is barley, maize, rice, wheat, another cereal crop, cassava, potato, soy, or a legume crop. Still another embodiment of this aspect includes the plant being barley.

In a further embodiment of this aspect, which may be combined with any of the preceding embodiments, the mycorrhization includes a symbiotic association of one or more plant parts selected from the group of a root system, a root, a root primordia, a root tip, a lateral root, a root meristem, or a root cell, with mycorrhizal fungi. An additional embodiment of this aspect includes the mycorrhizal fungi being selected from the group of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, or any combination thereof. In still another embodiment of this aspect, which may be combined with any of the preceding embodiments, increased mycorrhization enhances plant uptake of nutrients surround the plant roots selected from the group of phosphate, nitrate, or potassium, and increased mycorrhization optionally enhances plant uptake of water.

Yet another embodiment of this aspect, which may be combined with any of the preceding embodiments that does not have the nitrogen level around the plant roots being permissive of mycorrhization and/or symbiotic responses, further includes cultivating the genetically altered plant under conditions including a nitrogen level around the plant roots that suppresses mycorrhization and/or symbiotic responses, wherein the genetically altered plant of step a) further includes one or more genetic alterations that reduce the nitrogen level suppression of mycorrhization and/or symbiotic responses, and wherein step b) further includes cultivating the genetically altered plant under the nitrogen level around the plant roots, wherein the genetically altered plant has increased mycorrhization and/or promoted symbiotic responses as compared to a WT plant grown under the same conditions. In a further embodiment of this aspect, the one or more genetic alterations result in increased activity of a CEP peptide. In still another embodiment of this aspect, the increased activity is at least 10% greater, at least 20% greater, at least 30% greater, at least 40% greater, at least 50% greater, at least 75% greater, at least 100% greater, at least 150% greater, or at least 200% greater than the activity of the corresponding one or more proteins in the WT plant grown under the same conditions. In yet another embodiment of this aspect, which may be combined with any of the preceding embodiments that has the one or more genetic alterations resulting in increased activity of a CEP peptide, the increased activity is no greater than 500%, no greater than 400%, no greater than 300%, no greater than 200%, no greater than 150%, or no greater than 125% of the activity of the corresponding one or more proteins in the WT plant grown under the same conditions. In an additional embodiment of this aspect, which may be combined with any of the preceding embodiments that has the one or more genetic alterations resulting in increased activity of a CEP peptide, the CEP peptide includes an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23. In a further embodiment of this aspect, the CEP peptide includes SEQ ID NO: 17, SEQ ID NO: 18, SEQ ID NO: 19, SEQ ID NO: 20, SEQ ID NO: 21, SEQ ID NO: 22, or SEQ ID NO: 23. In still another embodiment of this aspect, which may be combined with any of the preceding embodiments that has the one or more genetic alterations resulting in increased activity of a CEP peptide, the CEP peptide is endogenous. Yet another embodiment of this aspect includes increased activity of the endogenous CEP peptide being achieved using a gene editing technique to introduce the one or more genetic alterations. An additional embodiment of this aspect includes the gene editing technique being selected from the group of transcription activator-like effector nuclease (TALEN) gene editing techniques, clustered Regularly Interspaced Short Palindromic Repeat (CRISPR/Cas) gene editing techniques, or zinc-finger nuclease (ZFN) gene editing techniques. In a further embodiment of this aspect, which may be combined with any of the preceding aspects that has a gene editing technique to introduce the one or more genetic alterations, the one or more genetic alterations that increase the activity of the endogenous protein are selected from the group of inactivating a repressor element that represses expression of the endogenous protein, removing a repressor element that represses expression of the endogenous protein, modulating the methylation state of a repressor element that represses expression of the endogenous protein, activating an enhancer element that increases expression of the endogenous protein, adding an enhancer element that increases expression of the endogenous protein, modulating the methylation state of an enhancer element that increases expression of the endogenous protein, adding a transcriptional activator recruiting or binding element that activates expression of the endogenous protein, replacing the endogenous promoter with an overexpression promoter that directs expression of the endogenous protein, modulating the methylation state of the endogenous promoter; modulating the methylation state of the endogenous coding sequence, adding elements that stabilize an endogenous mRNA encoding the endogenous protein, removing elements that destabilize the endogenous mRNA encoding the endogenous protein, modifying a coding sequence to increase stability of the endogenous protein, or modifying a coding sequence for the endogenous protein to increase activity of the endogenous protein. In still another embodiment of this aspect, which may be combined with any of the preceding embodiments that has the one or more genetic alterations resulting in increased activity of a CEP peptide, the increased activity is due to heterologous expression of the CEP peptide. An additional embodiment of this aspect includes increased activity of the heterologous CEP peptide being achieved using a vector including a first nucleic acid encoding the heterologous protein operably linked to a second nucleic acid encoding a promoter. A further embodiment of this aspect includes the promoter being selected from the group of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, or any combination thereof.

Yet another embodiment of this aspect, which may be combined with any of the preceding embodiments that does not have the nitrogen level around the plant roots being permissive of mycorrhization and/or symbiotic responses, further includes cultivating the genetically altered plant under conditions including a nitrogen level around the plant roots that suppresses mycorrhization and/or symbiotic responses, wherein step a) further includes cultivating the plant under conditions including the nitrogen level around the plant roots, and wherein step b) further includes exposing the plant or a part thereof to an effective amount of a CEP peptide, wherein the effective amount of the CEP peptide increases mycorrhization and/or promotes symbiotic responses in the plant or plant part as compared to the plant grown under the same conditions without the CEP peptide. In still another embodiment of this aspect, the effective amount of the CEP peptide includes at least 0.1 μM CEP peptide, at least 0.25 μM CEP peptide, at least 0.5 μM CEP peptide, at least 0.75 μM CEP peptide, at least 1 μM CEP peptide, at least 1.25 μM CEP peptide, at least 1.5 μM CEP peptide, at least 1.75 μM CEP peptide, or at least 2 μM CEP peptide. Further embodiments of this aspect, which may be combined with any of the preceding embodiments that have the plant or a part thereof being exposed to a CEP peptide, include the plant or the part thereof being exposed to the CEP peptide by direct application, application through irrigation or spraying, application in a seed coating, application in a seed coating with a mycorrhizal inoculum, or any combination thereof. In additional embodiments of this aspect, which may be combined with any of the preceding embodiments that have the plant or a part thereof being exposed to an effective amount of a CEP peptide, the CEP peptide includes an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23. In yet another embodiment of this aspect, the CEP peptide includes SEQ ID NO: 17, SEQ ID NO: 18, SEQ ID NO: 19, SEQ ID NO: 20, SEQ ID NO: 21, SEQ ID NO: 22, or SEQ ID NO: 23. In still another embodiment of this aspect, which may be combined with any of the preceding embodiments that does not have the nitrogen level around the plant roots being permissive of mycorrhization and/or symbiotic responses, the nitrogen level around the plant roots completely suppresses mycorrhization and/or symbiotic responses in the WT plant grown under the same conditions. An additional embodiment of this aspect includes the nitrogen around the plant roots being present in the form of nitrate, and the nitrate level around the plant roots being greater than 2.75 mM, greater than 3 mM, greater than 3.25 mM, greater than 3.5 mM, greater than 3.75 mM, greater than 4 mM, greater than 4.25 mM, greater than 4.5 mM, greater than 4.75 mM, greater than 5 mM, or greater than 5.5 mM.

A further aspect of the disclosure includes methods of cultivating a genetically altered plant with increased mycorrhization and/or promoted symbiotic responses under conditions including a nitrogen level around the plant roots that suppresses mycorrhization and/or symbiotic responses, including: (a) providing the genetically altered plant, wherein the plant or a part thereof includes one or more genetic alterations, wherein the one or more genetic alterations reduce the nitrogen level suppression of mycorrhization and/or symbiotic responses; and (b) cultivating the genetically altered plant under the nitrogen level around the plant roots, wherein the genetically altered plant has increased mycorrhization and/or promoted symbiotic responses as compared to a WT plant grown under the same conditions. In an additional embodiment of this aspect, the one or more genetic alterations result in increased activity of a CEP peptide. Yet another embodiment of this aspect includes the increased activity being at least 10% greater, at least 20% greater, at least 30% greater, at least 40% greater, at least 50% greater, at least 75% greater, at least 100% greater, at least 150% greater, or at least 200% greater than the activity of the corresponding one or more proteins in the WT plant grown under the same conditions. Still another embodiment of this aspect, which may be combined with any of the preceding embodiments that has the one or more genetic alterations resulting in increased activity, the increased activity is no greater than 500%, no greater than 400%, no greater than 300%, no greater than 200%, no greater than 150%, or no greater than 125% of the activity of the corresponding one or more proteins in the WT plant grown under the same conditions. In a further embodiment of this aspect, which may be combined with any of the preceding embodiments that has the one or more genetic alterations resulting in increased activity, the CEP peptide includes an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23. In yet another embodiment of this aspect, the CEP peptide includes SEQ ID NO: 17, SEQ ID NO: 18, SEQ ID NO: 19, SEQ ID NO: 20, SEQ ID NO: 21, SEQ ID NO: 22, or SEQ ID NO: 23.

In still another embodiment of this aspect, which may be combined with any of the preceding embodiments that has the one or more genetic alterations resulting in increased activity, the CEP peptide is endogenous. A further embodiment of this aspect includes increased activity of the CEP peptide being achieved using a gene editing technique to introduce the one or more genetic alterations. An additional embodiment of this aspect includes the gene editing technique being selected from the group of transcription activator-like effector nuclease (TALEN) gene editing techniques, clustered Regularly Interspaced Short Palindromic Repeat (CRISPR/Cas) gene editing techniques, or zinc-finger nuclease (ZFN) gene editing techniques. In an additional embodiment of this aspect, which may be combined with any of the preceding embodiments that has a gene editing technique to introduce the one or more genetic alterations, the one or more genetic alterations that increase the activity of the endogenous protein are selected from the group of inactivating a repressor element that represses expression of the endogenous protein, removing a repressor element that represses expression of the endogenous protein, modulating the methylation state of a repressor element that represses expression of the endogenous protein, activating an enhancer element that increases expression of the endogenous protein, adding an enhancer element that increases expression of the endogenous protein, modulating the methylation state of an enhancer element that increases expression of the endogenous protein, adding a transcriptional activator recruiting or binding element that activates expression of the endogenous protein, replacing the endogenous promoter with an overexpression promoter that directs expression of the endogenous protein, modulating the methylation state of the endogenous promoter, modulating the methylation state of the endogenous coding sequence, adding elements that stabilize an endogenous mRNA encoding the endogenous protein, removing elements that destabilize the endogenous mRNA encoding the endogenous protein, modifying a coding sequence to increase stability of the endogenous protein, or modifying a coding sequence for the endogenous protein to increase activity of the endogenous protein.

In yet another embodiment of this aspect, which may be combined with any of the preceding embodiments that has the one or more genetic alterations resulting in increased activity, the increased activity is due to heterologous expression of the CEP peptide. In a further embodiment of this aspect, increased activity of the heterologous CEP peptide is achieved using a vector including a first nucleic acid encoding the heterologous protein operably linked to a second nucleic acid encoding a promoter. An additional embodiment of this aspect includes the promoter being selected from the group of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, or any combination thereof.

In an additional embodiment of this aspect, which may be combined with any of the preceding embodiments, the nitrogen level around the plant roots completely suppresses mycorrhization and/or symbiotic responses in the WT plant grown under the same conditions. In still another embodiment of this aspect, which may be combined with any of the preceding embodiments, the phosphate level around the plant roots is permissive of mycorrhization and/or symbiotic responses in the WT plant grown under the same conditions. In yet another embodiment of this aspect, which may be combined with any of the preceding embodiments, the phosphate level around the plant roots includes less than 1000 μM phosphate, less than 800 μM phosphate, less than 600 μM phosphate, less than 500 μM phosphate, less than 400 μM phosphate, less than 300 μM phosphate, less than 200 μM phosphate, or less than 100 μM phosphate. In a further embodiment of this aspect, which may be combined with any of the preceding embodiments, the nitrogen around the plant roots is present in the form of nitrate, and the nitrate level around the plant roots is greater than 2.75 mM, greater than 3 mM, greater than 3.25 mM, greater than 3.5 mM, greater than 3.75 mM, greater than 4 mM, greater than 4.25 mM, greater than 4.5 mM, greater than 4.75 mM, greater than 5 mM, or greater than 5.5 mM. In still another embodiment of this aspect, which may be combined with any of the preceding embodiments, the plant is barley, maize, rice, wheat, another cereal crop, cassava, potato, soy, or a legume crop. Yet another embodiment of this aspect includes the plant being barley.

In still another embodiment of this aspect, which may be combined with any of the preceding embodiments, the mycorrhization includes a symbiotic association of one or more plant parts selected from the group of a root system, a root, a root primordia, a root tip, a lateral root, a root meristem, or a root cell, with mycorrhizal fungi. An additional embodiment of this aspect includes the mycorrhizal fungi being selected from the group of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, or any combination thereof. In still another embodiment of this aspect, which may be combined with any of the preceding embodiments, increased mycorrhization enhances plant uptake of nutrients surround the plant roots selected from the group of phosphate, nitrate, or potassium, and increased mycorrhization optionally enhances plant uptake of water.

A further aspect of this disclosure includes methods of cultivating a plant with increased mycorrhization and/or promoted symbiotic responses under conditions including a nitrogen level around the plant roots that suppresses mycorrhization and/or symbiotic responses, including: (a) cultivating the plant under conditions including the nitrogen level around the plant roots; and (b) exposing the plant or a part thereof to an effective amount of a CEP peptide, wherein the effective amount of the CEP peptide increases mycorrhization and/or promotes symbiotic responses in the plant or plant part as compared to the plant grown under the same conditions without the CEP peptide. In an additional embodiment of this aspect, the effective amount of the CEP peptide includes at least 0.1 μM CEP peptide, at least 0.25 μM CEP peptide, at least 0.5 μM CEP peptide, at least 0.75 μM CEP peptide, at least 1 μM CEP peptide, at least 1.25 μM CEP peptide, at least 1.5 μM CEP peptide, at least 1.75 μM CEP peptide, or at least 2 μM CEP peptide. In yet another embodiment of this aspect, which may be combined with any of the preceding embodiments, the plant or the part thereof is exposed to the CEP peptide by direct application, application through irrigation or spraying, application in a seed coating, application in a seed coating with a mycorrhizal inoculum, or any combination thereof. In still another embodiment of this aspect, which may be combined with any of the preceding embodiments, the CEP peptide includes an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23. In a further embodiment of this aspect, which may be combined with any of the preceding embodiments, the CEP peptide includes SEQ ID NO: 17, SEQ ID NO: 18, SEQ ID NO: 19, SEQ ID NO: 20, SEQ ID NO: 21, SEQ ID NO: 22, or SEQ ID NO: 23.

In yet another embodiment of this aspect, which may be combined with any of the preceding embodiments, the nitrogen level around the plant roots completely suppresses mycorrhization and/or symbiotic responses in the plant grown under the same conditions without the CEP peptide. In an additional embodiment of this aspect, which may be combined with any of the preceding embodiments, the phosphate level around the plant roots is permissive of mycorrhization and/or symbiotic responses in the plant grown under the same conditions without the CEP peptide. In a further embodiment of this aspect, the phosphate level around the plant roots includes less than 1000 μM phosphate, less than 800 μM phosphate, less than 600 μM phosphate, less than 500 μM phosphate, less than 400 μM phosphate, less than 300 μM phosphate, less than 200 μM phosphate, or less than 100 μM phosphate. In still another embodiment of this aspect, which may be combined with any of the preceding embodiments, the nitrogen around the plant roots is present in the form of nitrate, and the nitrate level around the plant roots is greater than 2.75 mM, greater than 3 mM, greater than 3.25 mM, greater than 3.5 mM, greater than 3.75 mM, greater than 4 mM, greater than 4.25 mM, greater than 4.5 mM, greater than 4.75 mM, greater than 5 mM, or greater than 5.5 mM. In a further embodiment of this aspect, which may be combined with any of the preceding embodiments, the plant is barley, maize, rice, wheat, another cereal crop, cassava, potato, soy, or a legume crop. An additional embodiment of this aspect includes the plant being barley.

In still another embodiment of this aspect, which may be combined with any of the preceding embodiments, the mycorrhization includes a symbiotic association of one or more plant parts selected from the group of a root system, a root, a root primordia, a root tip, a lateral root, a root meristem, or a root cell, with mycorrhizal fungi. An additional embodiment of this aspect includes the mycorrhizal fungi being selected from the group of Acaulosporaceae spp., Diversisporaceae spp., Gigasporaceae spp., Paciscoraceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, or any combination thereof. In still another embodiment of this aspect, which may be combined with any of the preceding embodiments, increased mycorrhization enhances plant uptake of nutrients surround the plant roots selected from the group of phosphate, nitrate, or potassium, and increased mycorrhization optionally enhances plant uptake of water.

An additional aspect of this disclosure includes methods of producing the genetically altered plant of any of the preceding embodiments that has increased activity of NSP1 or NSP2, including: (a) transforming a plant cell, tissue, or other explant with a vector including a first nucleic acid sequence encoding a NSP1 protein or a NSP2 protein operably linked to a second nucleic acid sequence encoding a promoter; (b) selecting successful transformation events by means of a selection agent, marker-assisted selection, or selective media; (c) regenerating the transformed cell, tissue, or other explant into a genetically altered plantlet; and (d) growing the genetically altered plantlet into a genetically altered plant with increased activity of the NSP1 protein or the NSP2 protein as compared to an untransformed WT plant. Yet another embodiment of this aspect further includes identifying successful introduction of the one or more genetic alterations by screening or selecting the plant cell, tissue, or other explant prior to step (b); screening or selecting plantlets between step (b) and (c); or screening or selecting plants after step (c). Still another embodiment of this aspect, which may be combined with any of the preceding embodiments, includes transformation being done using a transformation method selected from the group of particle bombardment (i.e., biolistics, gene gun), *Agrobacterium*-mediated transformation, *Rhizobium*-mediated transformation, or protoplast transfection or transformation. In an additional embodiment of this aspect, which may be combined with any of the preceding embodiments, the NSP1 protein includes an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207; or the NSP2 protein includes an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208. In a further embodiment of this aspect, the NSP1 protein includes SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207; or the NSP2 protein includes SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208. In yet another embodiment of this aspect, which may be combined with any of the preceding embodiments, the promoter is selected from the group of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, or any combination thereof. In still another embodiment of this aspect, which may be combined with any of the preceding embodiments, the first nucleic acid sequence and the second nucleic acid sequence are stably integrated into a nuclear genome of the plant.

A further aspect of this disclosure includes methods of producing the genetically altered plant of any of the preceding embodiments that has increased activity of NSP1 or NSP2, including (a) transforming a plant cell, tissue, or other explant with one or more gene editing components that target a nuclear genome sequence operably linked to an endogenous NSP1 protein or an endogenous NSP2 protein; (b) selecting successful transformation events by means of a screening technology, an enriching technology, a selection agent, marker-assisted selection, or selective media; (c) regenerating the transformed cell, tissue, or other explant into a genetically altered plantlet; and (d) growing the genetically altered plantlet into a genetically altered plant with overexpression of the NSP1 protein or the NSP2 protein as compared to an untransformed WT plant. In an additional embodiment of this aspect, the one or more gene editing components include a ribonucleoprotein complex that targets the nuclear genome sequence; a vector including a TALEN protein encoding sequence, wherein the TALEN protein targets the nuclear genome sequence; a vector including a ZFN protein encoding sequence, wherein the ZFN protein targets the nuclear genome sequence; an oligonucleotide donor (OND), wherein the OND targets the nuclear genome sequence; or a vector CRISPR/Cas enzyme encoding sequence and a targeting sequence, wherein the targeting sequence targets the nuclear genome sequence.

An additional aspect of this disclosure includes methods of producing the genetically altered plant of any of the preceding embodiments that has increased activity of CEP peptide, including: (a) transforming a plant cell, tissue, or other explant with a vector including a first nucleic acid sequence encoding a CEP peptide operably linked to a second nucleic acid sequence encoding a promoter; (b) selecting successful transformation events by means of a selection agent, marker-assisted selection, or selective media; (c) regenerating the transformed cell, tissue, or other explant into a genetically altered plantlet; and (d) growing the genetically altered plantlet into a genetically altered plant with increased activity of the CEP peptide as compared to an untransformed WT plant. Yet another embodiment of this aspect further includes identifying successful introduction of the one or more genetic alterations by screening or selecting the plant cell, tissue, or other explant prior to step (b); screening or selecting plantlets between step (b) and (c); or screening or selecting plants after step (c). Still another embodiment of this aspect, which may be combined with any of the preceding embodiments, includes transformation being done using a transformation method selected from the group of particle bombardment (i.e., biolistics, gene gun), *Agrobacterium*-mediated transformation, *Rhizobium*-mediated transformation, or protoplast transfection or transformation. In an additional embodiment of this aspect, which may be combined with any of the preceding embodiments, the CEP peptide includes an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23. In a further embodiment of this aspect, the CEP peptide includes SEQ ID NO: 17, SEQ ID NO: 18, SEQ ID NO: 19, SEQ ID NO: 20, SEQ ID NO: 21, SEQ ID NO: 22, or SEQ ID NO: 23. In yet another embodiment of this aspect, which may be combined with any of the preceding embodiments, the promoter is selected from the group of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, or any combination thereof. In still another embodiment of this aspect, which may be combined with any of the preceding embodiments, the first nucleic acid sequence and the second nucleic acid sequence are stably integrated into a nuclear genome of the plant.

A further aspect of this disclosure includes methods of producing the genetically altered plant of any of the preceding embodiments that has increased activity of CEP peptide, including (a) transforming a plant cell, tissue, or other explant with one or more gene editing components that target a nuclear genome sequence operably linked to an endogenous CEP peptide; (b) selecting successful transformation events by means of a screening technology, an enriching technology, a selection agent, marker-assisted selection, or selective media; (c) regenerating the transformed cell, tissue, or other explant into a genetically altered plantlet; and (d) growing the genetically altered plantlet into a genetically altered plant with overexpression of the CEP peptide as compared to an untransformed WT plant. In an additional embodiment of this aspect, the one or more gene editing components include a ribonucleoprotein complex that targets the nuclear genome sequence; a vector including a TALEN protein encoding sequence, wherein the TALEN protein targets the nuclear genome sequence; a vector including a ZFN protein encoding sequence, wherein the ZFN protein targets the nuclear genome sequence; an oligonucleotide donor (OND), wherein the OND targets the nuclear genome sequence; or a vector CRISPR/Cas enzyme encoding sequence and a targeting sequence, wherein the targeting sequence targets the nuclear genome sequence.

ENUMERATED EMBODIMENTS

1. A method of cultivating a genetically altered plant with increased mycorrhization and/or promoted symbiotic responses under conditions comprising a phosphate level around the plant roots that suppresses mycorrhization and/or symbiotic responses, comprising:
   a) providing the genetically altered plant, wherein the plant or a part thereof comprises one or more genetic alterations, wherein the one or more genetic alterations reduce the phosphate level suppression of mycorrhization and/or symbiotic responses; and
   b) cultivating the genetically altered plant under the phosphate level around the plant roots, wherein the genetically altered plant has increased mycorrhization and/or promoted symbiotic responses as compared to a wild type (WT) plant grown under the same conditions.
2. The method of embodiment 1, wherein the one or more genetic alterations result in increased activity of one or more of a NODULATION SIGNALING PATHWAY 1 (NSP1) protein and a NODULATION SIGNALING PATHWAY 2 (NSP2) protein.
3. The method of embodiment 2, wherein the increased activity is at least 10% greater, at least 20% greater, at least 30% greater, at least 40% greater, at least 50% greater, at least 75% greater, at least 100% greater, at least 150% greater, or at least 200% greater than the activity of the corresponding one or more proteins in the WT plant grown under the same conditions.
4. The method of embodiment 2 or embodiment 3, wherein the increased activity is no greater than 500%, no greater than 400%, no greater than 300%, no greater than 200%, no greater than 150%, or no greater than 125% of the activity of the corresponding one or more proteins in the WT plant grown under the same conditions.
5. The method of embodiments 2-4, wherein the NSP1 protein comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207.
6. The method of embodiment 5, wherein the NSP1 protein comprises SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207.
7. The method of embodiments 2-4, wherein the NSP2 protein comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO:

146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208.

8. The method of embodiment 7, wherein the NSP2 protein comprises SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208.

9. The method of any one of embodiments 2-8, wherein one or more of the NSP1 protein and the NSP2 protein is endogenous.

10. The method of embodiment 9, wherein increased activity of the one or more endogenous NSP1 protein and the endogenous NSP2 protein was achieved using a gene editing technique to introduce the one or more genetic alterations.

11. The method of embodiment 10, wherein the gene editing technique is selected from the group consisting of transcription activator-like effector nuclease (TALEN) gene editing techniques, clustered Regularly Interspaced Short Palindromic Repeat (CRISPR/Cas) gene editing techniques, and zinc-finger nuclease (ZFN) gene editing techniques.

12. The method of embodiment 10 or embodiment 11, wherein the one or more genetic alterations that increase the activity of the endogenous protein are selected from the group consisting of inactivating a repressor element that represses expression of the endogenous protein, removing a repressor element that represses expression of the endogenous protein, modulating the methylation state of a repressor element that represses expression of the endogenous protein, activating an enhancer element that increases expression of the endogenous protein, adding an enhancer element that increases expression of the endogenous protein, modulating the methylation state of an enhancer element that increases expression of the endogenous protein, adding a transcriptional activator recruiting or binding element that activates expression of the endogenous protein, replacing the endogenous promoter with an overexpression promoter that directs expression of the endogenous protein, modulating the methylation state of the endogenous promoter, modulating the methylation state of the endogenous coding sequence, adding elements that stabilize an endogenous mRNA encoding the endogenous protein, removing elements that destabilize the endogenous mRNA encoding the endogenous protein, modifying a coding sequence to increase stability of the endogenous protein, and modifying a coding sequence for the endogenous protein to increase activity of the endogenous protein.

13. The method of any one of embodiments 2-8, wherein the increased activity is due to heterologous expression of one or more of the NSP1 protein and the NSP2 protein.

14. The method of embodiment 13, wherein increased activity of the one or more of the heterologous NSP1 protein and the heterologous NSP2 protein is achieved using a vector comprising a first nucleic acid encoding the heterologous protein operably linked to a second nucleic acid encoding a promoter.

15. The method of embodiment 14, wherein the promoter is selected from the group consisting of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiC-CaMK promoter, and any combination thereof.

16. The method of any one of embodiments 1-15, wherein the phosphate level around the plant roots completely suppresses mycorrhization and/or symbiotic responses in the WT plant grown under the same conditions.

17. The method of any one of embodiments 1-16, wherein the nitrogen level around the plant roots is permissive of mycorrhization and/or symbiotic responses in the WT plant grown under the same conditions.

18. The method of embodiment 17, wherein the nitrogen around the plant roots is present in the form of nitrate, and wherein the nitrate level around the plant roots is less than 2.5 mM, less than 2 mM, less than 1.5 mM, less than 1 mM, less than 0.75 mM, less than 0.5 mM, or less than 0.25 mM.

19. The method of any one of embodiments 1-18, wherein the phosphate level around the plant roots comprises at least 100 μM phosphate, at least 200 μM phosphate, at least 300 μM phosphate, at least 400 μM phosphate, at least 500 μM phosphate, at least 600 μM phosphate, at least 800 μM phosphate, at least 1000 μM phosphate, at least 2000 μM phosphate, at least 3000 μM phosphate, at least 3750 μM phosphate, at least 4000 μM phosphate, or at least 5000 μM phosphate.

20. The method of any one of embodiments 1-19, wherein the plant is barley, maize, rice, wheat, another cereal crop, cassava, potato, soy, or a legume crop.

21. The method of embodiment 20, wherein the plant is barley.

22. The method of any one of embodiments 1-21, wherein the mycorrhization comprises a symbiotic association of one or more plant parts selected from the group consisting of a root system, a root, a root primordia, a root tip, a lateral root, a root meristem, and a root cell, with mycorrhizal fungi.

23. The method of embodiment 22, wherein mycorrhizal fungi are selected from the group consisting of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Sep-*

*toglomus* spp., *Claroideoglomus* spp., *Ambispora* spp., *Archaeospora* spp., *Geosiphon pyriformis, Paraglomus* spp., other species in the division Glomeromycota, and any combination thereof.

24. The method of any one of embodiments 1-23, wherein increased mycorrhization enhances plant uptake of nutrients surrounding the plant roots selected from the group consisting of phosphate, nitrate, and potassium, and wherein increased mycorrhization optionally enhances plant uptake of water.
25. The method of any one of embodiments 1-16 and 19-24, further comprising cultivating the genetically altered plant under conditions comprising a nitrogen level around the plant roots that suppresses mycorrhization and/or symbiotic responses, wherein the genetically altered plant of step a) further comprises one or more genetic alterations that reduce the nitrogen level suppression of mycorrhization and/or symbiotic responses, and wherein step b) further comprises cultivating the genetically altered plant under the nitrogen level around the plant roots, wherein the genetically altered plant has increased mycorrhization and/or promoted symbiotic responses as compared to a WT plant grown under the same conditions.
26. The method of embodiment 25, wherein the one or more genetic alterations result in increased activity of a C-TERMINALLY ENCODED PEPTIDE (CEP peptide).
27. The method of embodiment 26, wherein the increased activity is at least 10% greater, at least 20% greater, at least 30% greater, at least 40% greater, at least 50% greater, at least 75% greater, at least 100% greater, at least 150% greater, or at least 200% greater than the activity of the corresponding one or more proteins in the WT plant grown under the same conditions.
28. The method of embodiment 26 or embodiment 27, wherein the increased activity is no greater than 500%, no greater than 400%, no greater than 300%, no greater than 200%, no greater than 150%, or no greater than 125% of the activity of the corresponding one or more proteins in the WT plant grown under the same conditions.
29. The method of any one of embodiments 26-28, wherein the CEP peptide comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23.
30. The method of embodiment 29, wherein the CEP peptide comprises SEQ ID NO: 17, SEQ ID NO: 18, SEQ ID NO: 19, SEQ ID NO: 20, SEQ ID NO: 21, SEQ ID NO: 22, or SEQ ID NO: 23.
31. The method of any one of embodiments 26-30, wherein the CEP peptide is endogenous.
32. The method of embodiment 31, wherein increased activity of the endogenous CEP peptide was achieved using a gene editing technique to introduce the one or more genetic alterations.
33. The method of embodiment 32, wherein the gene editing technique is selected from the group consisting of transcription activator-like effector nuclease (TALEN) gene editing techniques, clustered Regularly Interspaced Short Palindromic Repeat (CRISPR/Cas) gene editing techniques, and zinc-finger nuclease (ZFN) gene editing techniques.
34. The method of embodiment 32 or embodiment 33, wherein the one or more genetic alterations that increase the activity of the endogenous protein are selected from the group consisting of inactivating a repressor element that represses expression of the endogenous protein, removing a repressor element that represses expression of the endogenous protein, modulating the methylation state of a repressor element that represses expression of the endogenous protein, activating an enhancer element that increases expression of the endogenous protein, adding an enhancer element that increases expression of the endogenous protein, modulating the methylation state of an enhancer element that increases expression of the endogenous protein, adding a transcriptional activator recruiting or binding element that activates expression of the endogenous protein, replacing the endogenous promoter with an overexpression promoter that directs expression of the endogenous protein, modulating the methylation state of the endogenous promoter; modulating the methylation state of the endogenous coding sequence, adding elements that stabilize an endogenous mRNA encoding the endogenous protein, removing elements that destabilize the endogenous mRNA encoding the endogenous protein, modifying a coding sequence to increase stability of the endogenous protein, and modifying a coding sequence for the endogenous protein to increase activity of the endogenous protein.
35. The method of any one of embodiments 26-30, wherein the increased activity is due to heterologous expression of the CEP peptide.
36. The method of embodiment 35, wherein increased activity of the heterologous CEP peptide is achieved using a vector comprising a first nucleic acid encoding the heterologous protein operably linked to a second nucleic acid encoding a promoter.
37. The method of embodiment 36, wherein the promoter is selected from the group consisting of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiC-CaMK promoter, and any combination thereof.
38. The method of any one of embodiments 1-16 and 19-24, further comprising cultivating the genetically altered plant under conditions comprising a nitrogen level around the plant roots that suppresses mycorrhization and/or symbiotic responses, wherein step a) further comprises cultivating the plant under conditions comprising the nitrogen level around the plant roots, and wherein step b) further comprises exposing the plant or a part thereof to an effective amount of a CEP peptide, wherein the effective amount of the CEP peptide increases mycorrhization and/or promotes symbiotic responses in the plant or plant part as compared to the plant grown under the same conditions without the CEP peptide.
39. The method of embodiment 38, wherein the effective amount of the CEP peptide comprises at least 0.1 μM CEP peptide, at least 0.25 μM CEP peptide, at least 0.5 μM CEP peptide, at least 0.75 μM CEP peptide, at least 1 μM CEP peptide, at least 1.25 μM CEP peptide, at least 1.5 μM CEP peptide, at least 1.75 μM CEP peptide, or at least 2 μM CEP peptide.

40. The method of embodiment 38 or embodiment 39, wherein the plant or the part thereof is exposed to the CEP peptide by direct application, application through irrigation or spraying, application in a seed coating, application in a seed coating with a mycorrhizal inoculum, or any combination thereof.

41. The method of any one of embodiments 38-40, wherein the CEP peptide comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23.

42. The method of embodiment 41, wherein the CEP peptide comprises SEQ ID NO: 17, SEQ ID NO: 18, SEQ ID NO: 19, SEQ ID NO: 20, SEQ ID NO: 21, SEQ ID NO: 22, or SEQ ID NO: 23.

43. The method of any one of embodiments 25-42, wherein the nitrogen level around the plant roots completely suppresses mycorrhization and/or symbiotic responses in the WT plant grown under the same conditions.

44. The method of embodiment 43, wherein the nitrogen around the plant roots is present in the form of nitrate, and wherein the nitrate level around the plant roots is greater than 2.75 mM, greater than 3 mM, greater than 3.25 mM, greater than 3.5 mM, greater than 3.75 mM, greater than 4 mM, greater than 4.25 mM, greater than 4.5 mM, greater than 4.75 mM, greater than 5 mM, or greater than 5.5 mM.

45. A method of cultivating a plant with increased mycorrhization and/or promoted symbiotic responses under conditions comprising a phosphate level around the plant roots that suppresses mycorrhization and/or symbiotic responses, comprising:

a) cultivating the plant under conditions comprising the phosphate level around the plant roots; and b) exposing the plant or a part thereof to an effective amount of a butenolide agent, wherein the effective amount of the butenolide agent increases mycorrhization and/or promotes symbiotic responses in the plant or plant part as compared to the plant grown under the same conditions without the butenolide agent.

46. The method of embodiment 45, wherein the effective amount of the butenolide agent comprises at least 0.1 μM butenolide agent, at least 0.25 μM butenolide agent, at least 0.5 μM butenolide agent, at least 0.75 μM butenolide agent, at least 1 μM butenolide agent, at least 1.25 μM butenolide agent, at least 1.5 μM butenolide agent, at least 1.75 μM butenolide agent, or at least 2 μM butenolide agent.

47. The method of embodiment 45 or embodiment 46, wherein the plant or the part thereof is exposed to the butenolide agent by direct application, application through irrigation or spraying, application in a seed coating, application in a seed coating with a mycorrhizal inoculum, or any combination thereof.

48. The method of any one of embodiments 45-47, wherein the butenolide agent is a strigolactone.

49. The method of embodiment 48, wherein the strigolactone is selected from the group consisting of 5-deoxystrigol, strigol, sorgomol, sorgolactone, other strigol-like compounds, 4-deoxyorobanchol, orobanchol, fabacyl acetate, solanocol, other orobanchol-like compounds, GR24, and any combination thereof.

50. The method of any one of embodiments 45-47, wherein the butenolide agent is a karrikin.

51. The method of embodiment 50, wherein the karrikin is selected from the group consisting of karrikin1, karrikin2, karrikin3, karrikin4, karrikin5, karrikin6, a mixture of karrikin1 and karrikin2, GR24, karrikin contained in liquid smoke, and any combination thereof.

52. The method of any one of embodiments 45-51, wherein the phosphate level around the plant roots completely suppresses mycorrhization and/or symbiotic responses in the plant grown under the same conditions without the butenolide agent.

53. The method of any one of embodiment 45-52, wherein the nitrogen level around the plant roots is permissive of mycorrhization and/or symbiotic responses in the plant grown under the same conditions without the butenolide agent.

54. The method of embodiment 53, wherein the nitrogen around the plant roots is present in the form of nitrate, and wherein the nitrate level around the plant roots is less than 2.5 mM, less than 2 mM, less than 1.5 mM, less than 1 mM, less than 0.75 mM, less than 0.5 mM, or less than 0.25 mM.

55. The method of any one of embodiments 45-54, wherein the phosphate level around the plant roots comprises at least 100 μM phosphate, at least 200 μM phosphate, at least 300 μM phosphate, at least 400 μM phosphate, at least 500 μM phosphate, at least 600 μM phosphate, at least 800 μM phosphate, at least 1000 μM phosphate, at least 2000 μM phosphate, at least 3000 μM phosphate, at least 3750 μM phosphate, at least 4000 μM phosphate, or at least 5000 μM phosphate.

56. The method of any one of embodiments 45-55, wherein the plant is barley, maize, rice, wheat, another cereal crop, cassava, potato, soy, or a legume crop.

57. The method of embodiment 56, wherein the plant is barley.

58. The method of any one of embodiments 45-57, wherein mycorrhization comprises a symbiotic association of one or more plant parts selected from the group consisting of a root system, a root, a root primordia, a root tip, a lateral root, a root meristem, and a root cell, with mycorrhizal fungi.

59. The method of embodiment 58, wherein mycorrhizal fungi are selected from the group consisting of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, and any combination thereof.

60. The method of any one of embodiments 45-59, wherein increased mycorrhization enhances plant uptake of nutrients surrounding the plant roots selected from the group consisting of phosphate, nitrate, and potassium, and wherein increased mycorrhization optionally enhances plant uptake of water.

61. The method of any one of embodiments 45-52 and 55-60, further comprising cultivating the plant under conditions comprising a nitrogen level around the plant roots that suppresses mycorrhization and/or symbiotic responses, wherein the plant of step a) further comprises one or more genetic alterations that reduce the nitrogen level suppression of mycorrhization and/or symbiotic responses, and wherein step b) further comprises cultivating the genetically altered plant under the nitrogen level around the plant roots, wherein the genetically altered plant has increased mycorrhization and/or promoted symbiotic responses as compared to a WT plant grown under the same conditions.

62. The method of embodiment 61, wherein the one or more genetic alterations result in increased activity of a CEP peptide.

63. The method of embodiment 62, wherein the increased activity is at least 10% greater, at least 20% greater, at least 30% greater, at least 40% greater, at least 50% greater, at least 75% greater, at least 100% greater, at least 150% greater, or at least 200% greater than the activity of the corresponding one or more proteins in the WT plant grown under the same conditions.

64. The method of embodiment 62 or embodiment 63, wherein the increased activity is no greater than 500%, no greater than 400%, no greater than 300%, no greater than 200%, no greater than 150%, or no greater than 125% of the activity of the corresponding one or more proteins in the WT plant grown under the same conditions.

65. The method of any one of embodiments 62-64, wherein the CEP peptide comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23.

66. The method of embodiment 65, wherein the CEP peptide comprises SEQ ID NO: 17, SEQ ID NO: 18, SEQ ID NO: 19, SEQ ID NO: 20, SEQ ID NO: 21, SEQ ID NO: 22, or SEQ ID NO: 23.

67. The method of any one of embodiments 62-66, wherein the CEP peptide is endogenous.

68. The method of embodiment 67, wherein increased activity of the endogenous CEP peptide was achieved using a gene editing technique to introduce the one or more genetic alterations.

69. The method of embodiment 68, wherein the gene editing technique is selected from the group consisting of transcription activator-like effector nuclease (TALEN) gene editing techniques, clustered Regularly Interspaced Short Palindromic Repeat (CRISPR/Cas) gene editing techniques, and zinc-finger nuclease (ZFN) gene editing techniques.

70. The method of embodiment 68 or embodiment 69, wherein the one or more genetic alterations that increase the activity of the endogenous protein are selected from the group consisting of inactivating a repressor element that represses expression of the endogenous protein, removing a repressor element that represses expression of the endogenous protein, modulating the methylation state of a repressor element that represses expression of the endogenous protein, activating an enhancer element that increases expression of the endogenous protein, adding an enhancer element that increases expression of the endogenous protein, modulating the methylation state of an enhancer element that increases expression of the endogenous protein, adding a transcriptional activator recruiting or binding element that activates expression of the endogenous protein, replacing the endogenous promoter with an overexpression promoter that directs expression of the endogenous protein, modulating the methylation state of the endogenous promoter; modulating the methylation state of the endogenous coding sequence, adding elements that stabilize an endogenous mRNA encoding the endogenous protein, removing elements that destabilize the endogenous mRNA encoding the endogenous protein, modifying a coding sequence to increase stability of the endogenous protein, and modifying a coding sequence for the endogenous protein to increase activity of the endogenous protein 71. The method of any one of embodiments 62-66, wherein the increased activity is due to heterologous expression of the CEP peptide.

72. The method of embodiment 71, wherein increased activity of the heterologous CEP peptide is achieved using a vector comprising a first nucleic acid encoding the heterologous protein operably linked to a second nucleic acid encoding a promoter.

73. The method of embodiment 72, wherein the promoter is selected from the group consisting of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiC-CaMK promoter, and any combination thereof.

74. The method of any one of embodiments 45-52 and 55-60, further comprising cultivating the plant under conditions comprising a nitrogen level around the plant roots that suppresses mycorrhization and/or symbiotic responses, wherein step a) further comprises cultivating the plant under conditions comprising the nitrogen level around the plant roots, and wherein step b) further comprises exposing the plant or a part thereof to an effective amount of a CEP peptide, wherein the effective amount of the CEP peptide increases mycorrhization and/or promotes symbiotic responses in the plant or plant part as compared to the plant grown under the same conditions without the CEP peptide.

75. The method of embodiment 74, wherein the effective amount of the CEP peptide comprises at least 0.1 μM CEP peptide, at least 0.25 μM CEP peptide, at least 0.5 μM CEP peptide, at least 0.75 μM CEP peptide, at least 1 μM CEP peptide, at least 1.25 μM CEP peptide, at least 1.5 μM CEP peptide, at least 1.75 μM CEP peptide, or at least 2 μM CEP peptide.

76. The method of embodiment 74 or embodiment 75, wherein the plant or the part thereof is exposed to the CEP peptide by direct application, application through irrigation or spraying, application in a seed coating, application in a seed coating with a mycorrhizal inoculum, or any combination thereof.

77. The method of any one of embodiments 74-76, wherein the CEP peptide comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23.

78. The method of embodiment 77, wherein the CEP peptide comprises SEQ ID NO: 17, SEQ ID NO: 18, SEQ ID NO: 19, SEQ ID NO: 20, SEQ ID NO: 21, SEQ ID NO: 22, or SEQ ID NO: 23.

79. The method of any one of embodiments 61-78, wherein the nitrogen level around the plant roots completely suppresses mycorrhization and/or symbiotic responses in the WT plant grown under the same conditions.

80. The method of embodiment 79, wherein the nitrogen around the plant roots is present in the form of nitrate, and wherein the nitrate level around the plant roots is greater than 2.75 mM, greater than 3 mM, greater than 3.25 mM, greater than 3.5 mM, greater than 3.75 mM, greater than 4 mM, greater than 4.25 mM, greater than 4.5 mM, greater than 4.75 mM, greater than 5 mM, or greater than 5.5 mM.

81. A method of cultivating a genetically altered plant with increased mycorrhization and/or promoted symbiotic responses under conditions comprising a nitrogen level around the plant roots that suppresses mycorrhization and/or symbiotic responses, comprising:
   a) providing the genetically altered plant, wherein the plant or a part thereof comprises one or more genetic alterations, wherein the one or more genetic alterations reduce the nitrogen level suppression of mycorrhization and/or symbiotic responses; and
   b) cultivating the genetically altered plant under the nitrogen level around the plant roots, wherein the genetically altered plant has increased mycorrhization and/or promoted symbiotic responses as compared to a WT plant grown under the same conditions.

82. The method of embodiment 81, wherein the one or more genetic alterations result in increased activity of a CEP peptide.

83. The method of embodiment 82, wherein the increased activity is at least 10% greater, at least 20% greater, at least 30% greater, at least 40% greater, at least 50% greater, at least 75% greater, at least 100% greater, at least 150% greater, or at least 200% greater than the activity of the corresponding one or more proteins in the WT plant grown under the same conditions.

84. The method of embodiment 82 or embodiment 83, wherein the increased activity is no greater than 500%, no greater than 400%, no greater than 300%, no greater than 200%, no greater than 150%, or no greater than 125% of the activity of the corresponding one or more proteins in the WT plant grown under the same conditions.

85. The method of any one of embodiments 82-84, wherein the CEP peptide comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23.

86. The method of embodiment 85, wherein the CEP peptide comprises SEQ ID NO: 17, SEQ ID NO: 18, SEQ ID NO: 19, SEQ ID NO: 20, SEQ ID NO: 21, SEQ ID NO: 22, or SEQ ID NO: 23.

87. The method of any one of embodiments 82-86, wherein the CEP peptide is endogenous.

88. The method of embodiment 87, wherein increased activity of the endogenous CEP peptide was achieved using a gene editing technique to introduce the one or more genetic alterations.

89. The method of embodiment 88, wherein the gene editing technique is selected from the group consisting of transcription activator-like effector nuclease (TALEN) gene editing techniques, clustered Regularly Interspaced Short Palindromic Repeat (CRISPR/Cas) gene editing techniques, and zinc-finger nuclease (ZFN) gene editing techniques.

90. The method of embodiment 88 or embodiment 89, wherein the one or more genetic alterations that increase the activity of the endogenous protein are selected from the group consisting of inactivating a repressor element that represses expression of the endogenous protein, removing a repressor element that represses expression of the endogenous protein, modulating the methylation state of a repressor element that represses expression of the endogenous protein, activating an enhancer element that increases expression of the endogenous protein, adding an enhancer element that increases expression of the endogenous protein, modulating the methylation state of an enhancer element that increases expression of the endogenous protein, adding a transcriptional activator recruiting or binding element that activates expression of the endogenous protein, replacing the endogenous promoter with an overexpression promoter that directs expression of the endogenous protein, modulating the methylation state of the endogenous promoter; modulating the methylation state of the endogenous coding sequence, adding elements that stabilize an endogenous mRNA encoding the endogenous protein, removing elements that destabilize the endogenous mRNA encoding the endogenous protein, modifying a coding sequence to increase stability of the endogenous protein, and modifying a coding sequence for the endogenous protein to increase activity of the endogenous protein 91. The method of any one of embodiments 82-86, wherein the increased activity is due to heterologous expression of the CEP peptide.

92. The method of embodiment 91, wherein increased activity of the heterologous CEP peptide is achieved using a vector comprising a first nucleic acid encoding the heterologous protein operably linked to a second nucleic acid encoding a promoter.

93. The method of embodiment 92, wherein the promoter is selected from the group consisting of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiC-CaMK promoter, and any combination thereof.

94. The method of any one of embodiments 81-93, wherein the nitrogen level around the plant roots completely suppresses mycorrhization and/or symbiotic responses in the WT plant grown under the same conditions.

95. The method of any one of embodiment 81-94, wherein the phosphate level around the plant roots is permissive of mycorrhization and/or symbiotic responses in the WT plant grown under the same conditions.

96. The method of embodiment 95, wherein the phosphate level around the plant roots comprises less than 1000 μM phosphate, less than 800 μM phosphate, less than 600 μM phosphate, less than 500 μM phosphate, less than 400 μM phosphate, less than 300 μM phosphate, less than 200 μM phosphate, or less than 100 μM phosphate.

97. The method of any one of embodiments 81-96, wherein the nitrogen around the plant roots is present in the form of nitrate, and wherein the nitrate level around the plant roots is greater than 2.75 mM, greater than 3 mM, greater than 3.25 mM, greater than 3.5 mM, greater than 3.75 mM, greater than 4 mM, greater than 4.25 mM, greater than 4.5 mM, greater than 4.75 mM, greater than 5 mM, or greater than 5.5 mM.

98. The method of any one of embodiments 81-97, wherein the plant is barley, maize, rice, wheat, another cereal crop, cassava, potato, soy, or a legume crop.

99. The method of embodiment 98, wherein the plant is barley.

100. The method of any one of embodiments 81-99, wherein the mycorrhization comprises a symbiotic association of one or more plant parts selected from the group consisting of a root system, a root, a root primordia, a root tip, a lateral root, a root meristem, and a root cell, with mycorrhizal fungi.

101. The method of embodiment 100, wherein mycorrhizal fungi are selected from the group consisting of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, and any combination thereof.

102. The method of any one of embodiments 81-101, wherein increased mycorrhization enhances plant uptake of nutrients surrounding the plant roots selected from the group consisting of phosphate, nitrate, and potassium, and wherein increased mycorrhization optionally enhances plant uptake of water.

103. A method of cultivating a plant with increased mycorrhization and/or promoted symbiotic responses under conditions comprising a nitrogen level around the plant roots that suppresses mycorrhization and/or symbiotic responses, comprising:
  a) cultivating the plant under conditions comprising the nitrogen level around the plant roots; and
  b) exposing the plant or a part thereof to an effective amount of a CEP peptide, wherein the effective amount of the CEP peptide increases mycorrhization and/or promotes symbiotic responses in the plant or plant part as compared to the plant grown under the same conditions without the CEP peptide.

104. The method of embodiment 105, wherein the effective amount of the CEP peptide comprises at least 0.1 μM CEP peptide, at least 0.25 μM CEP peptide, at least 0.5 μM CEP peptide, at least 0.75 μM CEP peptide, at least 1 μM CEP peptide, at least 1.25 μM CEP peptide, at least 1.5 μM CEP peptide, at least 1.75 μM CEP peptide, or at least 2 μM CEP peptide.

105. The method of embodiment 103 or embodiment 104, wherein the plant or the part thereof is exposed to the CEP peptide by direct application, application through irrigation or spraying, application in a seed coating, application in a seed coating with a mycorrhizal inoculum, or any combination thereof.

106. The method of any one of embodiments 103-105, wherein the CEP peptide comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23.

107. The method of embodiment 106, wherein the CEP peptide comprises SEQ ID NO: 17, SEQ ID NO: 18, SEQ ID NO: 19, SEQ ID NO: 20, SEQ ID NO: 21, SEQ ID NO: 22, or SEQ ID NO: 23.

108. The method of any one of embodiments 103-107, wherein the nitrogen level around the plant roots completely suppresses mycorrhization and/or symbiotic responses in the plant grown under the same conditions without the CEP peptide.

109. The method of any one of embodiment 103-108, wherein the phosphate level around the plant roots is permissive of mycorrhization and/or symbiotic responses in the plant grown under the same conditions without the CEP peptide.

110. The method of embodiment 109, wherein the phosphate level around the plant roots comprises less than 1000 μM phosphate, less than 800 μM phosphate, less than 600 μM phosphate, less than 500 μM phosphate, less than 400 μM phosphate, less than 300 μM phosphate, less than 200 μM phosphate, or less than 100 μM phosphate.

111. The method of any one of embodiments 103-110, wherein the nitrogen around the plant roots is present in the form of nitrate, and wherein the nitrate level around the plant roots is greater than 2.75 mM, greater than 3 mM, greater than 3.25 mM, greater than 3.5 mM, greater than 3.75 mM, greater than 4 mM, greater than 4.25 mM, greater than 4.5 mM, greater than 4.75 mM, greater than 5 mM, or greater than 5.5 mM.

112. The method of any one of embodiments 103-111, wherein the plant is barley, maize, rice, wheat, another cereal crop, cassava, potato, soy, or a legume crop.

113. The method of embodiment 112, wherein the plant is barley.

114. The method of any one of embodiments 103-113, wherein mycorrhization comprises a symbiotic association of one or more plant parts selected from the group consisting of a root system, a root, a root primordia, a root tip, a lateral root, a root meristem, and a root cell, with mycorrhizal fungi.

115. The method of embodiment 114, wherein mycorrhizal fungi are selected from the group consisting of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, and any combination thereof.

116. The method of any one of embodiments 103-115, wherein increased mycorrhization enhances plant uptake of nutrients surrounding the plant roots selected from the group consisting of phosphate, nitrate, potassium, and wherein increased mycorrhization optionally enhances plant uptake of water.

117. A method of producing the genetically altered plant of any one of embodiments 1-44, comprising:
  a. transforming a plant cell, tissue, or other explant with a vector comprising a first nucleic acid sequence encoding a NSP1 protein or a NSP2 protein operably linked to a second nucleic acid sequence encoding a promoter;

b. selecting successful transformation events by means of a selection agent, marker-assisted selection, or selective media;

c. regenerating the transformed cell, tissue, or other explant into a genetically altered plantlet; and d. growing the genetically altered plantlet into a genetically altered plant with increased activity of the NSP1 protein or the NSP2 protein as compared to an untransformed WT plant.

118. The method of embodiment 117, further comprising identifying successful introduction of the one or more genetic alterations by screening or selecting the plant cell, tissue, or other explant prior to step (b); screening or selecting plantlets between step (b) and (c); or screening or selecting plants after step (c).

119. The method of embodiment 117 or embodiment 118, wherein transformation is done using a transformation method selected from the group of particle bombardment (i.e., biolistics, gene gun), *Agrobacterium*-mediated transformation, *Rhizobium*-mediated transformation, and protoplast transfection or transformation.

120. The method of any one of embodiments 117-119, wherein the NSP1 protein comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207; or wherein the NSP2 protein comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208.

121. The method of embodiment 120, wherein the NSP1 protein comprises SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207; or wherein the NSP2 protein comprises SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208.

122. The method of any one of embodiments 117-121, wherein the promoter is selected from the group consisting of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, and any combination thereof.

123. The method of any one of embodiments 111-122, wherein the first nucleic acid sequence and the second nucleic acid sequence are stably integrated into a nuclear genome of the plant.

124. A method of producing the genetically altered plant of any one of embodiments 1-44, comprising:

a. transforming a plant cell, tissue, or other explant with one or more gene editing components that target a nuclear genome sequence operably linked to an endogenous NSP1 protein or an endogenous NSP2 protein;

b. selecting successful transformation events by means of a screening technology, an enriching technology, a selection agent, marker-assisted selection, or selective media;
c. regenerating the transformed cell, tissue, or other explant into a genetically altered plantlet; and
d. growing the genetically altered plantlet into a genetically altered plant with overexpression of the NSP1 protein or the NSP2 protein as compared to an untransformed WT plant.

125. The method of embodiment 124, wherein the one or more gene editing components comprise a ribonucleoprotein complex that targets the nuclear genome sequence; a vector comprising a TALEN protein encoding sequence, wherein the TALEN protein targets the nuclear genome sequence; a vector comprising a ZFN protein encoding sequence, wherein the ZFN protein targets the nuclear genome sequence; an oligonucleotide donor (OND), wherein the OND targets the nuclear genome sequence; or a vector CRISPR/Cas enzyme encoding sequence and a targeting sequence, wherein the targeting sequence targets the nuclear genome sequence.

126. A method of producing the genetically altered plant of any one of embodiments 25-37, 61-73, and 81-102, comprising:
a. transforming a plant cell, tissue, or other explant with a vector comprising a first nucleic acid sequence encoding a CEP peptide operably linked to a second nucleic acid sequence encoding a promoter;
b. selecting successful transformation events by means of a selection agent, marker-assisted selection, or selective media;
c. regenerating the transformed cell, tissue, or other explant into a genetically altered plantlet; and
d. growing the genetically altered plantlet into a genetically altered plant with increased activity of the CEP peptide as compared to an untransformed WT plant.

127. The method of embodiment 126, further comprising identifying successful introduction of the one or more genetic alterations by screening or selecting the plant cell, tissue, or other explant prior to step (b); screening or selecting plantlets between step (b) and (c); or screening or selecting plants after step (c).

128. The method of embodiment 126 or embodiment 127, wherein transformation is done using a transformation method selected from the group of particle bombardment (i.e., biolistics, gene gun), *Agrobacterium*-mediated transformation, *Rhizobium*-mediated transformation, and protoplast transfection or transformation.

129. The method of any one of embodiments 126-128, wherein the CEP peptide comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23.

130. The method of embodiment 129, wherein the CEP peptide comprises SEQ ID NO: 17, SEQ ID NO: 18, SEQ ID NO: 19, SEQ ID NO: 20, SEQ ID NO: 21, SEQ ID NO: 22, or SEQ ID NO: 23.

131. The method of any one of embodiments 126-130, wherein the promoter is selected from the group consisting of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, and any combination thereof.

132. The method of any one of embodiments 126-131, wherein the first nucleic acid sequence and the second nucleic acid sequence are stably integrated into a nuclear genome of the plant.

133. A method of producing the genetically altered plant of any one of embodiments 25-37, 61-73, and 81-102, comprising:
a. transforming a plant cell, tissue, or other explant with one or more gene editing components that target a nuclear genome sequence operably linked to an endogenous CEP peptide;
b. selecting successful transformation events by means of a screening technology, an enriching technology, a selection agent, marker-assisted selection, or selective media;
c. regenerating the transformed cell, tissue, or other explant into a genetically altered plantlet; and
d. growing the genetically altered plantlet into a genetically altered plant with overexpression of the CEP peptide as compared to an untransformed WT plant.

134. The method of embodiment 133, wherein the one or more gene editing components comprise a ribonucleoprotein complex that targets the nuclear genome sequence; a vector comprising a TALEN protein encoding sequence, wherein the TALEN protein targets the nuclear genome sequence; a vector comprising a ZFN protein encoding sequence, wherein the ZFN protein targets the nuclear genome sequence; an oligonucleotide donor (OND), wherein the OND targets the nuclear genome sequence; or a vector CRISPR/Cas enzyme encoding sequence and a targeting sequence, wherein the targeting sequence targets the nuclear genome sequence.

135. A method of cultivating a genetically altered plant with increased mycorrhization and/or promoted symbiotic responses under conditions comprising a phosphate level around the plant roots that suppresses mycorrhization and/or symbiotic responses, comprising:
a) providing the genetically altered plant, wherein the plant or a part thereof comprises one or more genetic alterations that result in increased activity of a NODULATION SIGNALING PATHWAY 1 (NSP1) protein, a NODULATION SIGNALING PATHWAY 2 (NSP2) protein, or both a NSP1 protein and a NSP2 protein as compared to an activity of a NSP1 protein or a NSP2 protein in a wild type (WT) plant grown under the same conditions, and wherein the one or more genetic alterations reduce the phosphate level suppression of mycorrhization and/or symbiotic responses; and
b) cultivating the genetically altered plant under the phosphate level around the plant roots, wherein the genetically altered plant has increased mycorrhization and/or promoted symbiotic responses as compared to the WT plant grown under the same conditions.

136. The method of embodiment 135, wherein the phosphate level around the plant roots completely suppresses mycorrhization and/or symbiotic responses in the WT plant grown under the same conditions, and wherein the nitrogen level around the plant roots is permissive of mycorrhization and/or symbiotic responses in the WT plant grown under the same conditions.

137. The method of embodiment 135 or 136, wherein the mycorrhization comprises a symbiotic association of one or more plant parts selected from the group consisting of a root system, a root, a root primordia, a root tip, a lateral root, a root meristem, and a root cell, with mycorrhizal fungi; and wherein mycorrhizal fungi are selected from the group consisting of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, and any combination thereof.

138. The method of any one of embodiments 135-137, wherein increased mycorrhization enhances plant uptake of nutrients surrounding the plant roots selected from the group consisting of phosphate, nitrate, and potassium, and wherein increased mycorrhization optionally enhances plant uptake of water.

139. The method of any one of embodiments 135-138, further comprising cultivating the genetically altered plant under conditions comprising a nitrogen level around the plant roots that suppresses mycorrhization and/or symbiotic responses, wherein the genetically altered plant of step (a) further comprises one or more genetic alterations that result in increased activity of a C-TERMINALLY ENCODED PEPTIDE (CEP peptide) as compared to an activity of a CEP peptide in a WT plant grown under the same conditions and that reduce the nitrogen level suppression of mycorrhization and/or symbiotic responses, and wherein step (b) further comprises cultivating the genetically altered plant under the nitrogen level around the plant roots, wherein the genetically altered plant has increased mycorrhization and/or promoted symbiotic responses as compared to the WT plant grown under the same conditions.

140. The method of any one of embodiments 135-138, further comprising cultivating the genetically altered plant under conditions comprising a nitrogen level around the plant roots that suppresses mycorrhization and/or symbiotic responses, wherein step (a) further comprises cultivating the plant under conditions comprising the nitrogen level around the plant roots, and wherein step (b) further comprises exposing the plant or a part thereof to an effective amount of a CEP peptide, wherein the effective amount of the CEP peptide increases mycorrhization and/or promotes symbiotic responses in the plant or plant part as compared to the plant grown under the same conditions without the CEP peptide.

141. The method of embodiment 139 or embodiment 140, wherein the nitrogen level around the plant roots completely suppresses mycorrhization and/or symbiotic responses in the WT plant grown under the same conditions.

142. A method of cultivating a plant with increased mycorrhization and/or promoted symbiotic responses under conditions comprising a phosphate level around the plant roots that suppresses mycorrhization and/or symbiotic responses, comprising:

a) cultivating the plant under conditions comprising the phosphate level around the plant roots; and b) exposing the plant or a part thereof to an effective amount of a butenolide agent, wherein the effective amount of the butenolide agent increases mycorrhization and/or promotes symbiotic responses in the plant or plant part as compared to a WT plant grown under the same conditions without the butenolide agent.

143. The method of embodiment 142, wherein the butenolide agent is a strigolactone, and wherein the strigolactone is selected from the group consisting of 5-deoxystrigol, strigol, sorgomol, sorgolactone, other strigol-like compounds, 4-deoxyorobanchol, orobanchol, fabacyl acetate, solanocol, other orobanchol-like compounds, GR24, and any combination thereof.

144. The method of embodiment 142, wherein the butenolide agent is a karrikin, and wherein the karrikin is selected from the group consisting of karrikin1, karrikin2, karrikin3, karrikin4, karrikin5, karrikin6, a mixture of karrikin1 and karrikin2, GR24, karrikin contained in liquid smoke, and any combination thereof.

145. The method of any one of embodiments 142-144, wherein the phosphate level around the plant roots completely suppresses mycorrhization and/or symbiotic responses in the WT plant grown under the same conditions without the butenolide agent, and wherein the nitrogen level around the plant roots is permissive of mycorrhization and/or symbiotic responses in the WT plant grown under the same conditions without the butenolide agent.

146. The method of any one of embodiments 142-145, further comprising cultivating the plant under conditions comprising a nitrogen level around the plant roots that suppresses mycorrhization and/or symbiotic responses, wherein the plant of step (a) further comprises one or more genetic alterations that result in increased activity of a CEP peptide as compared to an activity of a CEP peptide in a WT plant grown under the same conditions and that reduce the nitrogen level suppression of mycorrhization and/or symbiotic responses, and wherein step (b) further comprises cultivating the genetically altered plant under the nitrogen level around the plant roots, wherein the genetically altered plant has increased mycorrhization and/or promoted symbiotic responses as compared to a WT plant grown under the same conditions.

147. The method of any one of embodiments 142-145, further comprising cultivating the plant under conditions comprising a nitrogen level around the plant roots that suppresses mycorrhization and/or symbiotic responses, wherein step (a) further comprises cultivating the plant under conditions comprising the nitrogen level around the plant roots, and wherein step (b) further comprises exposing the plant or a part thereof to an effective amount of a CEP peptide, wherein the effective amount of the CEP peptide increases mycorrhization and/or promotes symbiotic responses in the plant or plant part as compared to the plant grown under the same conditions without the CEP peptide.

148. The method of embodiment 146 or embodiment 147, wherein the nitrogen level around the plant roots completely suppresses mycorrhization and/or symbiotic responses in the WT plant grown under the same conditions.

149. A method of cultivating a genetically altered plant with increased mycorrhization and/or promoted symbiotic responses under conditions comprising a nitrogen level around the plant roots that suppresses mycorrhization and/or symbiotic responses, comprising:

a) providing the genetically altered plant, wherein the plant or a part thereof comprises one or more genetic alterations that result in increased activity of a CEP peptide as compared to an activity of a CEP peptide in a WT plant grown under the same conditions, wherein the one or more genetic alterations reduce the nitrogen level suppression of mycorrhization and/or symbiotic responses; and b) cultivating the genetically altered plant under the nitrogen level around the plant roots, wherein the genetically altered plant has increased mycorrhization and/or promoted symbiotic responses as compared to a WT plant grown under the same conditions.

150. A method of cultivating a plant with increased mycorrhization and/or promoted symbiotic responses under conditions comprising a nitrogen level around the plant roots that suppresses mycorrhization and/or symbiotic responses, comprising:

a) cultivating the plant under conditions comprising the nitrogen level around the plant roots; and b) exposing the plant or a part thereof to an effective amount of a CEP peptide, wherein the effective amount of the CEP peptide increases mycorrhization and/or promotes symbiotic responses in the plant or plant part as compared to a WT plant grown under the same conditions without the CEP peptide.

151. A method of producing the genetically altered plant of embodiment 135, comprising:

a) transforming a plant cell, tissue, or other explant with a vector comprising a first nucleic acid sequence encoding a NSP1 protein or a NSP2 protein operably linked to a second nucleic acid sequence encoding a promoter;

b) selecting successful transformation events by means of a selection agent, marker-assisted selection, or selective media;

c) regenerating the transformed cell, tissue, or other explant into a genetically altered plantlet; and d) growing the genetically altered plantlet into a genetically altered plant with increased activity of the NSP1 protein or the NSP2 protein as compared to an untransformed WT plant.

152. A method of producing the genetically altered plant of embodiment 135, comprising:

a) transforming a plant cell, tissue, or other explant with one or more gene editing components that target a nuclear genome sequence operably linked to an endogenous NSP1 protein or an endogenous NSP2 protein;

b) selecting successful transformation events by means of a screening technology, an enriching technology, a selection agent, marker-assisted selection, or selective media;

c) regenerating the transformed cell, tissue, or other explant into a genetically altered plantlet; and d) growing the genetically altered plantlet into a genetically altered plant with overexpression of the NSP1 protein or the NSP2 protein as compared to an untransformed WT plant.

153. A method of producing the genetically altered plant of embodiment 139, comprising:

a) transforming a plant cell, tissue, or other explant with a vector comprising a first nucleic acid sequence encoding a CEP peptide operably linked to a second nucleic acid sequence encoding a promoter;

b) selecting successful transformation events by means of a selection agent, marker-assisted selection, or selective media;

c) regenerating the transformed cell, tissue, or other explant into a genetically altered plantlet; and d) growing the genetically altered plantlet into a genetically altered plant with increased activity of the CEP peptide as compared to an untransformed WT plant.

154. A method of producing the genetically altered plant of embodiment 139, comprising:

a) transforming a plant cell, tissue, or other explant with one or more gene editing components that target a nuclear genome sequence operably linked to an endogenous CEP peptide;

b) selecting successful transformation events by means of a screening technology, an enriching technology, a selection agent, marker-assisted selection, or selective media;

c) regenerating the transformed cell, tissue, or other explant into a genetically altered plantlet; and d) growing the genetically altered plantlet into a genetically altered plant with overexpression of the CEP peptide as compared to an untransformed WT plant.

155. A method of producing a genetically altered plant with increased mycorrhization and/or promoted symbiotic responses under conditions comprising a phosphate level around the plant roots that suppresses mycorrhization and/or symbiotic responses, comprising:

introducing into the plant or a part thereof one or more genetic alterations that result in increased activity of a NODULATION SIGNALING PATHWAY 1 (NSP1) protein, a NODULATION SIGNALING PATHWAY 2 (NSP2) protein, or both a NSP1 protein and a NSP2 protein as compared to an activity of a NSP1 protein or a NSP2 protein in a wild type (WT) plant grown under the same conditions, and wherein the one or more genetic alterations reduce the phosphate level suppression of mycorrhization and/or symbiotic responses.

156. The method of embodiment 155, wherein the introducing comprises:

a) transforming a plant cell, tissue, or other explant with a vector comprising a first nucleic acid sequence encoding a NSP1 protein or a NSP2 protein operably linked to a second nucleic acid sequence encoding a promoter;

b) selecting successful transformation events by means of a selection agent, marker-assisted selection, or selective media;

c) regenerating the transformed cell, tissue, or other explant into a genetically altered plantlet; and d) growing the genetically altered plantlet into a genetically altered plant with increased activity of the NSP1 protein or the NSP2 protein as compared to an untransformed WT plant.

157. The method of embodiment 155, wherein the introducing comprises:

a) transforming a plant cell, tissue, or other explant with one or more gene editing components that target a nuclear genome sequence operably linked to an endogenous NSP1 protein or an endogenous NSP2 protein;

b) selecting successful transformation events by means of a screening technology, an enriching technology, a selection agent, marker-assisted selection, or selective media;
c) regenerating the transformed cell, tissue, or other explant into a genetically altered plantlet; and
d) growing the genetically altered plantlet into a genetically altered plant with overexpression of the NSP1 protein or the NSP2 protein as compared to an untransformed WT plant.

158. The method of any one of embodiments 155-157, wherein the mycorrhization comprises a symbiotic association of one or more plant parts selected from the group consisting of a root system, a root, a root primordia, a root tip, a lateral root, a root meristem, and a root cell, with mycorrhizal fungi; and wherein mycorrhizal fungi are selected from the group consisting of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, and any combination thereof.

159. The method of any one of embodiments 155-158, wherein increased mycorrhization enhances plant uptake of nutrients surrounding the plant roots selected from the group consisting of phosphate, nitrate, and potassium, and wherein increased mycorrhization optionally enhances plant uptake of water.

160. The method of any one of embodiments 155-159, further comprising:
introducing one or more genetic alterations that result in increased activity of a C-TERMINALLY ENCODED PEPTIDE (CEP peptide) as compared to an activity of a CEP peptide in a WT plant grown under the same conditions and that reduce the nitrogen level suppression of mycorrhization and/or symbiotic responses.

161. The method of embodiment 160, wherein the one or more genetic alterations that result in increased activity of the CEP peptide are introduced before, during, or after the one or more genetic alterations that result in increased activity of one or more of the NSP1 protein and the NSP2 protein.

162. A set of one or more isolated DNA molecules for introducing both the one or more genetic alterations that result in increased activity of the CEP peptide and the one or more genetic alterations that result in increased activity of one or more of the NSP1 protein and the NSP2 protein.

163. A method of producing a genetically altered plant with increased mycorrhization and/or promoted symbiotic responses under conditions comprising a nitrogen level around the plant roots that suppresses mycorrhization and/or symbiotic responses, comprising:
introducing into the plant or a part thereof one or more genetic alterations that result in increased activity of a CEP peptide as compared to an activity of a CEP peptide in a WT plant grown under the same conditions, wherein the one or more genetic alterations reduce the nitrogen level suppression of mycorrhization and/or symbiotic responses.

164. The method of claim 163, wherein the introducing comprises:
a) transforming a plant cell, tissue, or other explant with a vector comprising a first nucleic acid sequence encoding a CEP peptide operably linked to a second nucleic acid sequence encoding a promoter;
b) selecting successful transformation events by means of a selection agent, marker-assisted selection, or selective media;
c) regenerating the transformed cell, tissue, or other explant into a genetically altered plantlet; and
d) growing the genetically altered plantlet into a genetically altered plant with increased activity of the CEP peptide as compared to an untransformed WT plant.

165. The method of claim 163, wherein the introducing comprises:
a) transforming a plant cell, tissue, or other explant with one or more gene editing components that target a nuclear genome sequence operably linked to an endogenous CEP peptide;
b) selecting successful transformation events by means of a screening technology, an enriching technology, a selection agent, marker-assisted selection, or selective media;
c) regenerating the transformed cell, tissue, or other explant into a genetically altered plantlet; and
d) growing the genetically altered plantlet into a genetically altered plant with overexpression of the CEP peptide as compared to an untransformed WT plant.

166. A genetically altered plant comprising one or more genetic alterations and further comprising increased mycorrhization and/or promoted symbiotic responses under conditions comprising a phosphate level around the plant roots that suppresses mycorrhization and/or symbiotic responses, wherein the one or more genetic alterations reduce the phosphate level suppression of mycorrhization and/or symbiotic responses, and wherein the genetically altered plant has increased mycorrhization and/or promoted symbiotic responses as compared to a wild type (WT) plant grown under the same conditions including the phosphate level around the plant roots that suppresses mycorrhization and/or symbiotic responses.

167. The genetically altered plant of embodiment 166, wherein the one or more genetic alterations result in increased activity of one or more of a NODULATION SIGNALING PATHWAY 1 (NSP1) protein and a NODULATION SIGNALING PATHWAY 2 (NSP2) protein.

168. The genetically altered plant of embodiment 167, wherein the increased activity is at least 10% greater, at least 20% greater, at least 30% greater, at least 40% greater, at least 50% greater, at least 75% greater, at least 100% greater, at least 150% greater, or at least 200% greater than the activity of the corresponding one or more proteins in the WT plant grown under the same conditions.

169. The genetically altered plant of embodiment 167 or embodiment 168, wherein the increased activity is no greater than 500%, no greater than 400%, no greater than 300%, no greater than 200%, no greater than 150%, or no greater than 125% of the activity of the corresponding one or more proteins in the WT plant grown under the same conditions.

170. The genetically altered plant of any one of embodiments 167-169, wherein the NSP1 protein comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207.

171. The genetically altered plant of embodiment 170, wherein the NSP1 protein comprises SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207.

172. The genetically altered plant of any one of embodiments 167-169, wherein the NSP2 protein comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208.

173. The genetically altered plant of embodiment 172, wherein the NSP2 protein comprises SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208.

174. The genetically altered plant of any one of embodiments 167-173, wherein one or more of the NSP1 protein and the NSP2 protein is endogenous.

175. The genetically altered plant of embodiment 174, wherein increased activity of the one or more endogenous NSP1 protein and the endogenous NSP2 protein was achieved using a gene editing technique to introduce the one or more genetic alterations.

176. The genetically altered plant of embodiment 175, wherein the gene editing technique is selected from the group consisting of transcription activator-like effector nuclease (TALEN) gene editing techniques, clustered Regularly Interspaced Short Palindromic Repeat (CRISPR/Cas) gene editing techniques, and zinc-finger nuclease (ZFN) gene editing techniques.

177. The genetically altered plant of embodiment 175 or embodiment 176, wherein the one or more genetic alterations that increase the activity of the endogenous protein are selected from the group consisting of inactivating a repressor element that represses expression of the endogenous protein, removing a repressor element that represses expression of the endogenous protein, modulating a methylation state of a repressor element that represses expression of the endogenous protein, activating an enhancer element that increases expression of the endogenous protein, adding an enhancer element that increases expression of the endogenous protein, modulating a methylation state of an enhancer element that increases expression of the endogenous protein, adding a transcriptional activator recruiting or binding element that activates expression of the endogenous protein, replacing an endogenous promoter with an overexpression promoter that directs expression of the endogenous protein, modulating a methylation state of the endogenous promoter, modulating a methylation state of an endogenous coding sequence, adding elements that stabilize an endogenous mRNA encoding the endogenous protein, removing elements that destabilize an endogenous mRNA encoding the endogenous protein, modifying a coding sequence to increase stability of the endogenous protein, and modifying a coding sequence for the endogenous protein to increase activity of the endogenous protein.

178. The genetically altered plant of any one of embodiments 167-173, wherein the increased activity is due to transgenic expression of one or more of the NSP1 protein and the NSP2 protein.

179. The genetically altered plant of embodiment 178, wherein increased activity of the one or more of the transgenic NSP1 protein and the transgenic NSP2 protein is achieved using a vector comprising a first nucleic acid encoding the transgenic protein operably linked to a second nucleic acid encoding a promoter.
180. The genetically altered plant of embodiment 179, wherein the promoter is selected from the group consisting of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, and any combination thereof.
181. The genetically altered plant of any one of embodiments 166-180, wherein the phosphate level around the plant roots completely suppresses mycorrhization and/or symbiotic responses in the WT plant grown under the same conditions.
182. The genetically altered plant of any one of embodiments 166-181, wherein the nitrogen level around the plant roots is permissive of mycorrhization and/or symbiotic responses in the WT plant grown under the same conditions.
183. The genetically altered plant of embodiment 182, wherein the nitrogen around the plant roots is present in the form of nitrate, and wherein the nitrate level around the plant roots is less than 2.5 mM, less than 2 mM, less than 1.5 mM, less than 1 mM, less than 0.75 mM, less than 0.5 mM, or less than 0.25 mM.
184. The genetically altered plant of any one of embodiments 166-183, wherein the phosphate level around the plant roots comprises at least 100 μM phosphate, at least 200 μM phosphate, at least 300 μM phosphate, at least 400 μM phosphate, at least 500 μM phosphate, at least 600 μM phosphate, at least 800 μM phosphate, at least 1000 μM phosphate, at least 2000 μM phosphate, at least 3000 μM phosphate, at least 3750 μM phosphate, at least 4000 μM phosphate, or at least 5000 μM phosphate.
185. The genetically altered plant of any one of embodiments 166-184, wherein the plant is barley, maize, rice, wheat, another cereal crop, cassava, potato, soy, or a legume crop.
186. The genetically altered plant of any one of embodiments 166-184, wherein the plant is barley, maize, wheat, oat, rye, sorghum, cassava, cowpea, pea, or lentil.
187. The genetically altered plant of embodiment 185 or embodiment 186, wherein the plant is barley.
188. The genetically altered plant of any one of embodiments 166-187, wherein the mycorrhization comprises a symbiotic association of one or more plant parts selected from the group consisting of a root system, a root, a root primordia, a root tip, a lateral root, a root meristem, and a root cell, with mycorrhizal fungi.
189. The genetically altered plant of embodiment 188, wherein mycorrhizal fungi are selected from the group consisting of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, and any combination thereof.
190. The genetically altered plant of any one of embodiments 166-189, wherein increased mycorrhization enhances plant uptake of nutrients surrounding the plant roots selected from the group consisting of phosphate, nitrate, and potassium, and wherein increased mycorrhization optionally enhances plant uptake of water.
191. The genetically altered plant of any one of embodiments 166-181 and 184-190, further comprising one or more genetic alterations that reduce the nitrogen level suppression of mycorrhization and/or symbiotic responses, and wherein the genetically altered plant has increased mycorrhization and/or promoted symbiotic responses as compared to a WT plant grown under the same conditions including a nitrogen level that suppresses mycorrhization and/or symbiotic responses.
192. The genetically altered plant of embodiment 191, wherein the one or more genetic alterations result in increased activity of a C-TERMINALLY ENCODED PEPTIDE (CEP peptide).
193. The genetically altered plant of embodiment 192, wherein the increased activity of CEP peptide is at least 10% greater, at least 20% greater, at least 30% greater, at least 40% greater, at least 50% greater, at least 75% greater, at least 100% greater, at least 150% greater, or at least 200% greater than the activity of the corresponding CEP peptide in the WT plant grown under the same conditions.
194. The genetically altered plant of embodiment 192 or embodiment 193, wherein the increased activity of CEP peptide is no greater than 500%, no greater than 400%, no greater than 300%, no greater than 200%, no greater than 150%, or no greater than 125% of the activity of the corresponding CEP peptide in the WT plant grown under the same conditions.
195. The genetically altered plant of any one of embodiments 192-194, wherein the CEP peptide comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23.
196. The genetically altered plant of embodiment 195, wherein the CEP peptide comprises SEQ ID NO: 17, SEQ ID NO: 18, SEQ ID NO: 19, SEQ ID NO: 20, SEQ ID NO: 21, SEQ ID NO: 22, or SEQ ID NO: 23.
197. The genetically altered plant of any one of embodiments 192-196, wherein the CEP peptide is endogenous.
198. The genetically altered plant of embodiment 197, wherein increased activity of the endogenous CEP peptide was achieved using a gene editing technique to introduce the one or more genetic alterations.
199. The genetically altered plant of embodiment 198, wherein the gene editing technique is selected from the group consisting of transcription activator-like effector nuclease (TALEN) gene editing techniques, clustered Regularly Interspaced Short Palindromic Repeat (CRISPR/Cas) gene editing techniques, and zinc-finger nuclease (ZFN) gene editing techniques.
200. The genetically altered plant of embodiment 198 or embodiment 199, wherein the one or more genetic alterations that increase the activity of the endogenous protein are selected from the group consisting of inactivating a repressor element that represses expression of the endogenous protein, removing a repressor element that represses expression of the endogenous protein, modulating a methylation state of a repressor element that represses expression of the endogenous protein, activating an enhancer element that increases expression of the endogenous protein, adding an enhancer element that increases expression of the endogenous protein, modulating a methylation state of an enhancer element that increases expression of the endogenous protein, adding a transcriptional activator recruiting or binding element that activates expression of the endogenous protein, replacing an endogenous promoter with an overexpression promoter that directs expression of the endogenous protein, modulating a methylation state of an endogenous promoter; modulating a methylation state of ab endogenous coding sequence, adding elements that stabilize an endogenous mRNA encoding the endogenous protein, removing elements that destabilize ab endogenous mRNA encoding the endogenous protein, modifying a coding sequence to increase stability of the endogenous protein, and modifying a coding sequence for the endogenous protein to increase activity of the endogenous protein.

201. The genetically altered plant of any one of embodiments 192-196, wherein the increased activity is due to transgenic expression of the CEP peptide.

202. The genetically altered plant of embodiment 201, wherein increased activity of the transgenic CEP peptide is achieved using a vector comprising a third nucleic acid encoding the transgenic protein operably linked to a fourth nucleic acid encoding a promoter.

203. The genetically altered plant of embodiment 202, wherein the promoter of the fourth nucleic acid is selected from the group consisting of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiC-CaMK promoter, and any combination thereof.

204. The genetically altered plant of any one of embodiments 191-203, wherein the nitrogen level around the plant roots completely suppresses mycorrhization and/or symbiotic responses in the WT plant grown under the same conditions.

205. The genetically altered plant of embodiment 204, wherein the nitrogen around the plant roots is present in the form of nitrate, and wherein the nitrate level around the plant roots is greater than 2.75 mM, greater than 3 mM, greater than 3.25 mM, greater than 3.5 mM, greater than 3.75 mM, greater than 4 mM, greater than 4.25 mM, greater than 4.5 mM, greater than 4.75 mM, greater than 5 mM, or greater than 5.5 mM.

206. A genetically altered plant comprising one or more genetic alterations and further comprising increased mycorrhization and/or promoted symbiotic responses under conditions comprising a nitrogen level around the plant roots that suppresses mycorrhization and/or symbiotic responses, wherein the one or more genetic alterations reduce the nitrogen level suppression of mycorrhization and/or symbiotic responses, and wherein the genetically altered plant has increased mycorrhization and/or promoted symbiotic responses as compared to a WT plant grown under the same conditions including the nitrogen level around the plant roots that suppresses mycorrhization and/or symbiotic responses.

207. The genetically altered plant of embodiment 206, wherein the one or more genetic alterations result in increased activity of a CEP peptide.

208. The genetically altered plant of embodiment 207, wherein the increased activity is at least 10% greater, at least 20% greater, at least 30% greater, at least 40% greater, at least 50% greater, at least 75% greater, at least 100% greater, at least 150% greater, or at least 200% greater than the activity of the corresponding CEP peptide in the WT plant grown under the same conditions.

209. The genetically altered plant of embodiment 207 or embodiment 208, wherein the increased activity is no greater than 500%, no greater than 400%, no greater than 300%, no greater than 200%, no greater than 150%, or no greater than 125% of the activity of the corresponding CEP peptide in the WT plant grown under the same conditions.

210. The genetically altered plant of any one of embodiments 207-209, wherein the CEP peptide comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23.

211. The genetically altered plant of embodiment 210, wherein the CEP peptide comprises SEQ ID NO: 17, SEQ ID NO: 18, SEQ ID NO: 19, SEQ ID NO: 20, SEQ ID NO: 21, SEQ ID NO: 22, or SEQ ID NO: 23.

212. The genetically altered plant of any one of embodiments 207-211, wherein the CEP peptide is endogenous.

213. The genetically altered plant of embodiment 212, wherein increased activity of the endogenous CEP peptide was achieved using a gene editing technique to introduce the one or more genetic alterations.

214. The genetically altered plant of embodiment 213, wherein the gene editing technique is selected from the group consisting of transcription activator-like effector nuclease (TALEN) gene editing techniques, clustered Regularly Interspaced Short Palindromic Repeat (CRISPR/Cas) gene editing techniques, and zinc-finger nuclease (ZFN) gene editing techniques.

215. The genetically altered plant of embodiment 213 or embodiment 214, wherein the one or more genetic alterations that increase the activity of the endogenous protein are selected from the group consisting of inactivating a repressor element that represses expression of the endogenous protein, removing a repressor element that represses expression of the endogenous protein, modulating a methylation state of a repressor element that represses expression of the endogenous protein, activating an enhancer element that increases expression of the endogenous protein, adding an enhancer element that increases expression of the endogenous protein, modulating a methylation state of an enhancer element that increases expression of the endogenous protein, adding a transcriptional activator recruiting or binding element that activates expression of the endogenous protein, replacing an endogenous promoter with an overexpression promoter that directs expression of the endogenous protein, modulating a methylation state of an endogenous promoter; modulating a methylation state of an endogenous coding sequence, adding elements that stabilize an endogenous mRNA encoding the endogenous protein, removing elements that destabilize ab endogenous mRNA encoding the endogenous protein, modifying a coding sequence to increase stability of the endogenous protein, and modifying a coding sequence for the endogenous protein to increase activity of the endogenous protein 216. The genetically altered plant of any one of embodiments 207-212, wherein the increased activity is due to transgenic expression of the CEP peptide.

217. The genetically altered plant of embodiment 216, wherein increased activity of the transgenic CEP peptide is achieved using a vector comprising a first nucleic acid encoding the transgenic protein operably linked to a second nucleic acid encoding a promoter.

218. The genetically altered plant of embodiment 217, wherein the promoter is selected from the group consisting of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, and any combination thereof.

219. The genetically altered plant of any one of embodiments 206-218, wherein the nitrogen level around the plant roots completely suppresses mycorrhization and/or symbiotic responses in the WT plant grown under the same conditions.

220. The genetically altered plant of any one of embodiment 206-219, wherein the phosphate level around the plant roots is permissive of mycorrhization and/or symbiotic responses in the WT plant grown under the same conditions.

221. The genetically altered plant of embodiment 220, wherein the phosphate level around the plant roots comprises less than 1000 μM phosphate, less than 800 μM phosphate, less than 600 μM phosphate, less than 500 μM phosphate, less than 400 μM phosphate, less than 300 μM phosphate, less than 200 μM phosphate, or less than 100 μM phosphate.

222. The genetically altered plant of any one of embodiments 206-221, wherein the nitrogen around the plant roots is present in the form of nitrate, and wherein the nitrate level around the plant roots is greater than 2.75 mM, greater than 3 mM, greater than 3.25 mM, greater than 3.5 mM, greater than 3.75 mM, greater than 4 mM, greater than 4.25 mM, greater than 4.5 mM, greater than 4.75 mM, greater than 5 mM, or greater than 5.5 mM.

223. The genetically altered plant of any one of embodiments 206-222, wherein the plant is barley, maize, rice, wheat, another cereal crop, cassava, potato, soy, or a legume crop.

224. The genetically altered plant of any one of embodiments 206-222, wherein the plant is barley, maize, wheat, oat, rye, sorghum, cassava, cowpea, pea, or lentil.

225. The genetically altered plant of embodiment 223 or embodiment 224, wherein the plant is barley.

226. The genetically altered plant of any one of embodiments 206-225, wherein the mycorrhization comprises a symbiotic association of one or more plant parts selected from the group consisting of a root system, a root, a root primordia, a root tip, a lateral root, a root meristem, and a root cell, with mycorrhizal fungi.

227. The genetically altered plant of embodiment 226, wherein mycorrhizal fungi are selected from the group consisting of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, and any combination thereof.

228. The genetically altered plant of any one of embodiments 206-227, wherein increased mycorrhization enhances plant uptake of nutrients surrounding the plant roots selected from the group consisting of phosphate, nitrate, and potassium, and wherein increased mycorrhization optionally enhances plant uptake of water.

229. An isolated DNA molecule or vector comprising a first nucleic acid sequence encoding a NODULATION SIGNALING PATHWAY 1 (NSP1) protein or a NODULATION SIGNALING PATHWAY 2 (NSP2) protein, wherein the DNA molecule or vector when integrated into a plant produces increased activity of the protein which increases mycorrhization and/or promotes symbiotic responses in the plant under conditions comprising a phosphate level around the plant roots that suppresses mycorrhization and/or symbiotic responses and wherein the plant has increased mycorrhization and/or promoted symbiotic responses as compared to a wild type (WT) plant without the DNA molecule or vector grown under the same conditions including the phosphate level around the plant roots that suppresses mycorrhization and/or symbiotic responses.

230. The isolated DNA molecule or vector of embodiment 229, wherein the increased activity is at least 10% greater, at least 20% greater, at least 30% greater, at least 40% greater, at least 50% greater, at least 75% greater, at least 100% greater, at least 150% greater, or at least 200% greater than the activity of the corresponding one or more proteins in the WT plant grown under the same conditions.

231. The isolated DNA molecule or vector of embodiment 229 or embodiment 230, wherein the increased activity is no greater than 500%, no greater than 400%, no greater than 300%, no greater than 200%, no greater than 150%, or no greater than 125% of the activity of the corresponding one or more proteins in the WT plant grown under the same conditions.

232. The isolated DNA molecule or vector of any one of embodiments 229-231, wherein the NSP1 protein comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207.

233. The isolated DNA molecule or vector of embodiment 232, wherein the NSP1 protein comprises SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207.

234. The isolated DNA molecule or vector of embodiments 229-231, wherein the NSP2 protein comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208.

235. The isolated DNA molecule or vector of embodiment 234, wherein the NSP2 protein comprises SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208.

236. The isolated DNA molecule or vector of any one of embodiments 229-235, wherein the first nucleic acid is operably linked to a second nucleic acid encoding a promoter.

237. The isolated DNA molecule or vector of embodiment 236, wherein the promoter is selected from the group consisting of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, and any combination thereof.

238. The isolated DNA molecule or vector of any one of embodiments 229-237, wherein the phosphate level around the plant roots completely suppresses mycorrhization and/or symbiotic responses in the WT plant grown under the same conditions.

239. The isolated DNA molecule or vector of any one of embodiments 229-238, wherein the nitrogen level around the plant roots is permissive of mycorrhization and/or symbiotic responses in the WT plant grown under the same conditions.

240. The isolated DNA molecule or vector of embodiment 239, wherein the nitrogen around the plant roots is present in the form of nitrate, and wherein the nitrate level around the plant roots is less than 2.5 mM, less than 2 mM, less than 1.5 mM, less than 1 mM, less than 0.75 mM, less than 0.5 mM, or less than 0.25 mM.

241. The isolated DNA molecule or vector of any one of embodiments 229-240, wherein the phosphate level around the plant roots comprises at least 100 μM phosphate, at least 200 μM phosphate, at least 300 μM phosphate, at least 400 μM phosphate, at least 500 μM phosphate, at least 600 μM phosphate, at least 800 μM phosphate, at least 1000 μM phosphate, at least 2000 μM phosphate, at least 3000 μM phosphate, at least 3750 μM phosphate, at least 4000 μM phosphate, or at least 5000 μM phosphate.

242. The isolated DNA molecule or vector of any one of embodiments 229-241, wherein the plant is barley, maize, rice, wheat, another cereal crop, cassava, potato, soy, or a legume crop.

243. The isolated DNA molecule or vector of any one of embodiments 229-241, wherein the plant is barley, maize, wheat, oat, rye, sorghum, cassava, cowpea, pea, or lentil.

244. The isolated DNA molecule or vector of embodiment 242 or embodiment 243, wherein the plant is barley.

245. The isolated DNA molecule or vector of any one of embodiments 229-244, wherein the mycorrhization comprises a symbiotic association of one or more plant parts selected from the group consisting of a root system, a root, a root primordia, a root tip, a lateral root, a root meristem, and a root cell, with mycorrhizal fungi.

246. The isolated DNA molecule or vector of embodiment 245, wherein mycorrhizal fungi are selected from the group consisting of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, and any combination thereof.

247. The isolated DNA molecule or vector of any one of embodiments 229-246, wherein increased mycorrhization enhances plant uptake of nutrients surrounding the plant roots selected from the group consisting of phosphate, nitrate, and potassium, and wherein increased mycorrhization optionally enhances plant uptake of water.

248. An isolated DNA molecule or vector comprising a first nucleic acid sequence encoding a CEP peptide, wherein the DNA molecule or vector when integrated into a plant produces increased activity of the CEP peptide which increases mycorrhization and/or promotes symbiotic responses in the plant under conditions comprising a nitrogen level around the plant roots that suppresses mycorrhization and/or symbiotic responses and wherein the plant has increased mycorrhization and/or promoted symbiotic responses as compared to a WT plant grown under the same conditions including the nitrogen level around the plant roots that suppresses mycorrhization and/or symbiotic responses.

249. The isolated DNA molecule or vector of embodiment 248, wherein the increased activity is at least 10% greater, at least 20% greater, at least 30% greater, at least 40% greater, at least 50% greater, at least 75% greater, at least 100% greater, at least 150% greater, or at least 200% greater than the activity of the corresponding CEP peptide in the WT plant grown under the same conditions.

250. The isolated DNA molecule or vector of embodiment 248 or embodiment 249, wherein the increased activity is no greater than 500%, no greater than 400%, no greater than 300%, no greater than 200%, no greater than 150%, or no greater than 125% of the activity of the corresponding CEP peptide in the WT plant grown under the same conditions.

251. The isolated DNA molecule or vector of any one of embodiments 248-250, wherein the CEP peptide comprises an amino acid sequence with at least 70% sequence identity to, at least 75% sequence identity to, at least 80% sequence identity to, at least 85% sequence identity to, at least 90% sequence identity to, at least 95% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23.

252. The isolated DNA molecule or vector of embodiment 251, wherein the CEP peptide comprises SEQ ID NO: 17, SEQ ID NO: 18, SEQ ID NO: 19, SEQ ID NO: 20, SEQ ID NO: 21, SEQ ID NO: 22, or SEQ ID NO: 23.

253. The isolated DNA molecule or vector of any one of embodiments 229-252, wherein the first nucleic acid is operably linked to a second nucleic acid encoding a promoter.

254. The isolated DNA molecule or vector of embodiment 253, wherein the promoter is selected from the group consisting of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, and any combination thereof.

255. The isolated DNA molecule or vector of any one of embodiments 248-254, wherein the nitrogen level around the plant roots completely suppresses mycorrhization and/or symbiotic responses in the WT plant grown under the same conditions.

256. The isolated DNA molecule or vector of any one of embodiments 248-255, wherein the phosphate level around the plant roots is permissive of mycorrhization and/or symbiotic responses in the WT plant grown under the same conditions.

257. The isolated DNA molecule or vector of embodiment 256, wherein the phosphate level around the plant roots comprises less than 1000 μM phosphate, less than 800 μM phosphate, less than 600 μM phosphate, less than 500 μM phosphate, less than 400 μM phosphate, less than 300 μM phosphate, less than 200 μM phosphate, or less than 100 μM phosphate.

258. The isolated DNA molecule or vector of any one of embodiments 248-257, wherein the nitrogen around the plant roots is present in the form of nitrate, and wherein the nitrate level around the plant roots is greater than 2.75 mM, greater than 3 mM, greater than 3.25 mM, greater than 3.5 mM, greater than 3.75 mM, greater than 4 mM, greater than 4.25 mM, greater than 4.5 mM, greater than 4.75 mM, greater than 5 mM, or greater than 5.5 mM.

259. The isolated DNA molecule or vector of any one of embodiments 248-258, wherein the plant is barley, maize, rice, wheat, another cereal crop, cassava, potato, soy, or a legume crop.

260. The isolated DNA molecule or vector of any one of embodiments 248-258, wherein the plant is barley, maize, wheat, oat, rye, sorghum, cassava, cowpea, pea, or lentil.

261. The isolated DNA molecule or vector of embodiment 259 or embodiment 260, wherein the plant is barley.

262. The isolated DNA molecule or vector of any one of embodiments 248-261, wherein the mycorrhization comprises a symbiotic association of one or more plant parts selected from the group consisting of a root system, a root, a root primordia, a root tip, a lateral root, a root meristem, and a root cell, with mycorrhizal fungi.

263. The isolated DNA molecule or vector of embodiment 262, wherein mycorrhizal fungi are selected from the group consisting of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, and any combination thereof.

264. The isolated DNA molecule or vector of any one of embodiments 248-263, wherein increased mycorrhization enhances plant uptake of nutrients surrounding the plant roots selected from the group consisting of phosphate, nitrate, and potassium, and wherein increased mycorrhization optionally enhances plant uptake of water.

BRIEF DESCRIPTION OF THE DRAWINGS

FIG. 1A shows results from *M. truncatula* plants grown under limiting nitrate and phosphate conditions (−N−P, 0 mM $NO_3^-$ and 0.0075 mM $PO_4^-$). FIG. 1B shows results from *M. truncatula* plants grown under conditions replete with nitrate and phosphate (+N+P, 5 mM $NO_3^-$ and 3.75 mM $PO_4^-$). In FIGS. 1A-1B, the x-axis indicates the molar concentration of oligosaccharide, and the y-axis indicates the percentage of cells that responded with nuclear calcium oscillations ("Cells spiking"). Root epidermal cells were treated with either of two COs, CO8 (grey line, solid triangles) or CO4 (light grey line, open circles), or with either of two LCOs, a non-sulfated LCO (NS-LCO, grey line, open triangles) or a LCO derived from *Sinorhizobium meliloti* (SmLCO, black line, solid circles).

FIG. 2A shows the expression levels of genes associated with symbiosis signaling, with expression of HA1 shown on the left, and expression of Vapyrin shown on the right. As indicated on the x-axis, plants were treated with either water ($H_2O$), peptidoglycan (PGN), CO8, or SmLCO. FIG. 2B shows the expression levels of genes associated with immunity signaling, with expression of PR10 shown on the left, and expression of Chitinase shown on the right. As indicated on the x-axis, plants were treated with either water ($H_2O$), peptidoglycan (PGN), CO8, or a fragment of flagellin (flg22). In FIGS. 2A-2B the x-axis shows the molecule added to *M. truncatula*, the y-axis shows the mean relative expression level of the gene (fold change compared to water treatment) ±standard error of mean (s.e.m.), and the bars show the conditions under which the expression was measured, with limiting nitrate and phosphate conditions (−N−P, 0 mM $NO_3^-$ and 0.0075 mM $PO_4^-$) shown as white bars, and conditions replete with nitrate and phosphate (+N+P, 5 mM $NO_3^-$ and 3.75 mM $PO_4^-$) shown as black bars. For each sample n=8, the asterisks indicate the results of a Student's t-test, and *** indicates a P value<0.001.

FIG. 5A shows the level of nodule formation under conditions with limiting nitrate and phosphate (−N−P, white bars), or conditions with replete nitrate and phosphate (+N+P, black bars). The x-axis indicates the number of weeks post inoculation, and the y-axis indicates the number of nodules per plant. The number of white nodules is shown on the left, and the number of pink nodules is shown on the right, as indicated. FIG. 5B shows the percentage of arbuscular mycorrhiza (% AM colonization, as indicated on the y-axis) after three weeks under conditions with limiting nitrate and phosphate (−N−P, white bar), or conditions with replete nitrate and phosphate (+N+P, black bar). FIGS. 5C-5D show assays of infection by *Phytophthora palmivora*. FIG. 5C provides lesion size per root length (y-axis) of *P. palmivora*-infected plants after 48 hours under conditions with limiting nitrate and phosphate (−N−P, gray bars), or conditions with replete nitrate and phosphate (+N+P, black bars). FIG. 5D provides *P. palmivora* EF1a expression levels relative to *M. truncatula* Histone expression levels (y-axis) from *P. palmivora*-infected plants after 24 or 48 hours (as indicated on the x-axis) under conditions with limiting nitrate and phosphate (−N−P, gray bars), or conditions with replete nitrate and phosphate (+N+P, black bars). In each of FIGS. 5A-5D, the mean±s.e.m is shown, and the asterisks indicate the results of a Student's t-test, with  indicating P<0.01, and * indicating P<0.001. +N+P indicates 5 mM $NO_3^-$ and 3.75 mM $PO_4^-$ and −N−P indicates 0 mM $NO_3^-$ and 0.0075 mM $PO_4^-$.

FIG. 6A shows percentage colonization measured 7 weeks post inoculation of wild type (WT) *Z. mays*, as well as ccamk-1 and ccamk-2 mutants, as indicated from left to right on the x-axis. FIG. 6B shows percentage colonization measured 7 weeks post inoculation of wild type *H. vulgare* (WT), and ccamk-1, symrk-1, symrk-2, cyclops-2, and cyclops-3 mutants, as indicated from left to right along the x-axis. As shown in the legends on the right of FIGS. 6A-6B, the lightest grey bars represent the total root colonization (Total Colonisation), and, from light to darkest grey, the other bars represent the external hyphae (EH), hyphopodia (H), internal hyphae (IH), arbuscules (A), vesicles (V), and spores (S). FIG. 6C shows percentage colonization measured 5 weeks post inoculation of *H. vulgare* plants of wild type (WT) *H. vulgare*, as well as rlk2-1, rlk4-1, and rlk5-1 mutants, as indicated from left to right on the x-axis. As shown in the key on the right, the lightest grey bars represent the total root colonization, and, from light to darkest grey, the other bars represent the hyphopodia, intraradical hyphae, and arbuscules. Colonization was measured 5 weeks post inoculation. In FIGS. 6A-6C, the y-axis represents the percentage of roots colonized by mycorrhizal fungi, the shading of each bar represents the fungal structure that was quantified, and the dots on the histogram represent the level of colonization of individual plants.

In FIG. 10A, plants were grown under high nitrate (HN; 3 mM $NO_3^-$) and a range of phosphate concentrations. As indicated from left to right along the x-axis, plants were grown with 10 μM $PO_4^-$ and 3 mM $NO_3$, 500 μM $PO_4^-$ and 3 mM $NO_3$, 1 mM $PO_4^-$ and 3 mM $NO_3$, or 2.5 mM $PO_4^-$ and 3 mM $NO_3$. In FIG. 10B, plants were grown under low nitrate (HN; 0.5 mM $NO_3^-$) and a range of phosphate concentrations. As indicated from left to right along the x-axis, plants were grown with 10 μM $PO_4^-$ and 0.5 mM $NO_3$, 500 μM $PO_4^-$ and 0.5 mM $NO_3$, 1 mM $PO_4^-$ and 0.5 mM $NO_3$, or 2.5 mM $PO_4^-$ and 0.5 mM $NO_3^-$. In FIG. 10C, plants were grown under 3 mM $NO_3^-$ and a range of phosphate concentrations, as indicated on the x-axis, and colonization with *R. irregularis* was measured after either 5 or 7 weeks post inoculation (wpi). From left to right along the x-axis, plants were grown with 10 μM $PO_4^-$ and measured 5 wpi, grown with 10 μM $PO_4^-$ and measured 7 wpi, grown with 100 μM $PO_4^-$ and measured 5 wpi, grown with 100 μM $PO_4^-$ and measured 7 wpi, grown with 250 μM $PO_4^-$ and measured 5 wpi, grown with 250 μM $PO_4^-$ and measured 7 wpi, grown with 500 μM $PO_4^-$ and measured 5 wpi, or grown with 500 μM $PO_4^-$ and measured 7 wpi. The asterisks above the brackets at the top of FIG. 10C indicate statistically significant differences in total colonization, as determined by a Kruskal-Wallis test. In FIGS. 10A-10C, the y-axis represents the percentage of roots colonized by mycorrhizal fungi, and the shading of each bar represents the fungal structure that was quantified. The lightest grey bars represent the total root colonization, and, from light to darkest grey, the other bars represent the external hyphae (EH), hyphopodia (H), internal hyphae (IH), arbuscules (A), vesicles (V), and spores (S).

FIG. 11A provides traces of nuclear calcium oscillations produced by *M. truncatula* root epidermal cells. Cells were grown under high phosphate and limiting nitrate levels (3.75 mM $PO_4^-$ and 0 mM $NO_3^-$). The top trace represents control cells that were pretreated with buffer alone; the second trace represents cells that were pretreated with 1 μM of strigolactone 5-deoxystrigol for 12 hours; and the third trace represents cells that were pretreated with a 1 μM mixture of karrikin 1 and karrikin 2 (KARs) for 12 hours. All cells were secondarily treated with $10^{-8}$ M NS-LCO. The scale bar indicates a span of 10 minutes, and the fractions indicate the number of cells that responded over the total number of cells analyzed. FIG. 11B shows representative calcium traces in atrichoblasts of *H. vulgare* wild type lateral roots in response to treatment with SmLCO ($10^{-7}$ M) when grown under phosphate replete (−N+P, 0 mM $NO_3^-$ and 0.5 mM $PO_4^-$) conditions after pretreatment with control buffer (Buff), 1p M strigolactone (SL), or a 1 μM mixture of karrikin 1 and karrikin 2 (KARs) for 12 hrs.

FIG. 13 provides the relative expression levels of *H. vulgare* genes, including LysM receptor-like kinase homologs, in response to treatment with strigolactone or karrikin signaling molecules, as determined by qPCR. The

*H. vulgare* gene is indicated on the x-axis including, from left to right, HvSTH7b (a homolog of *Arabidopsis* STH7, a karrikin-responsive gene (Nelson et al., 2010, PNAS)), HvRLK2, HvRLK3, HvRLK7, HvRLK9, and HvRLK10. Relative expression levels are shown on the y-axis. Values shown are the mean of three samples±SD. ** indicates P<0.01, and * indicates 0.01<P<0.05, as determined by a Student's t-test. *H. vulgare* roots were grown on −N+P (0 mM $NO_3^-$ and 0.5 mM $PO_4^-$) plates for 4 days, then treated for 24 hours with either 0.1 μM strigolactone 5-deoxystrigol (grey, left bar in each group), 0.1 μM karrikins $KAR_1$ and $KAR_2$ (dark grey, middle bar in each group), or 0.1 μM synthetic strigolactone analog GR24 (light grey, right bar in each group).

Figure 14A:
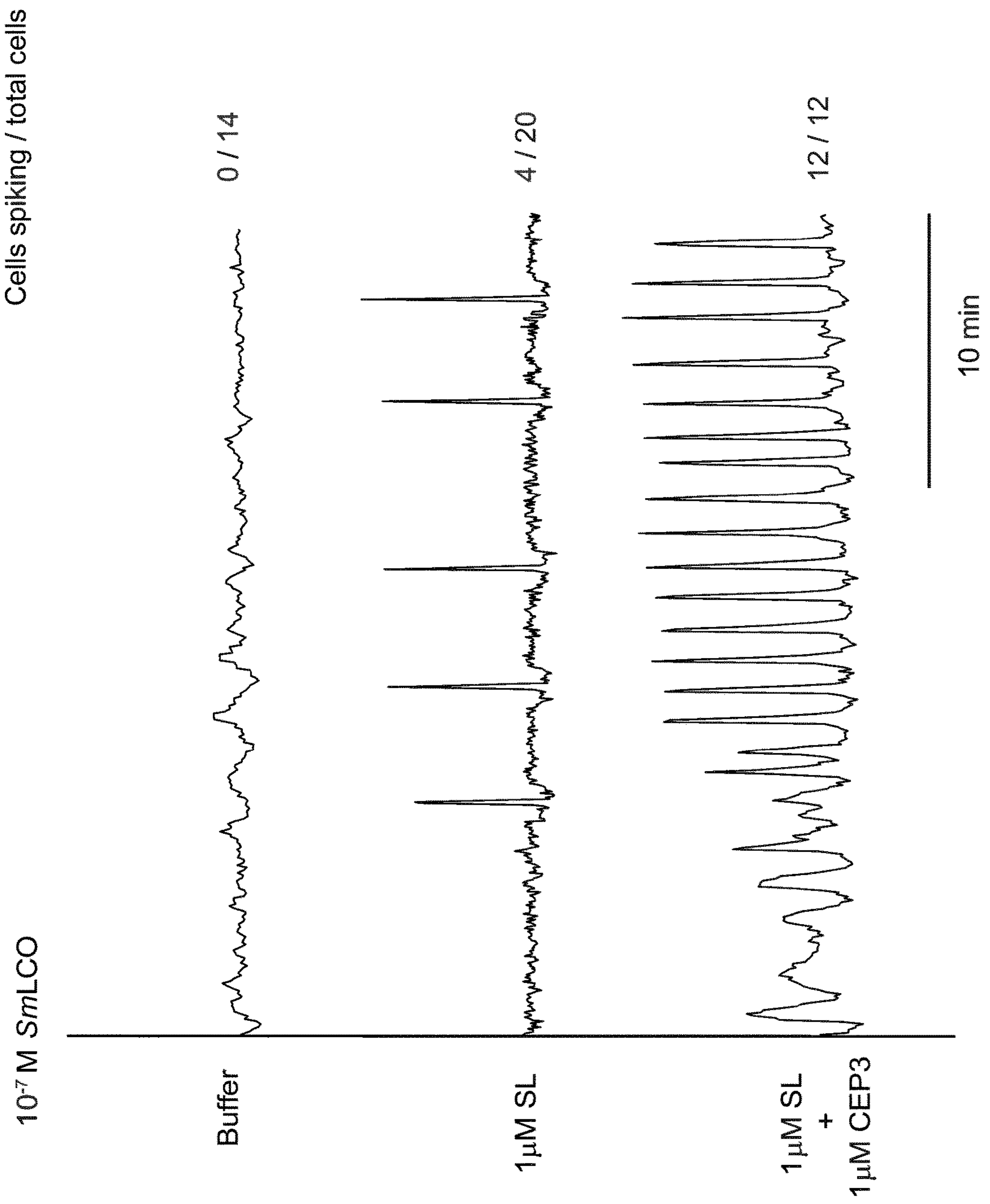
Figure 14C:
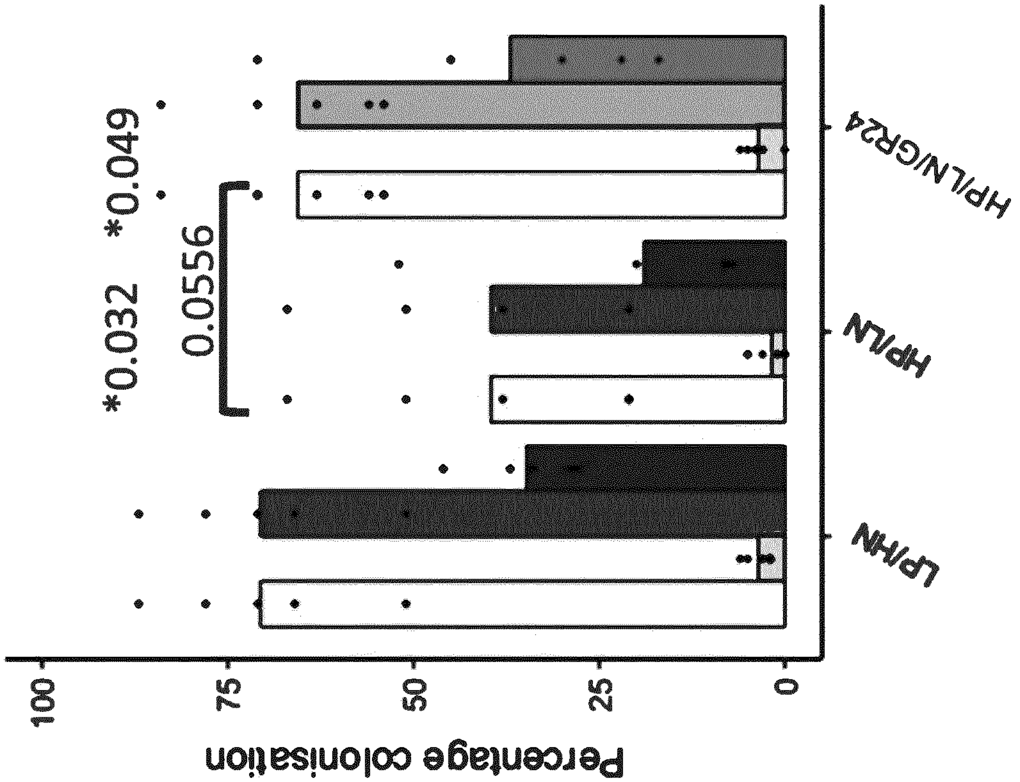
Figure 14B:
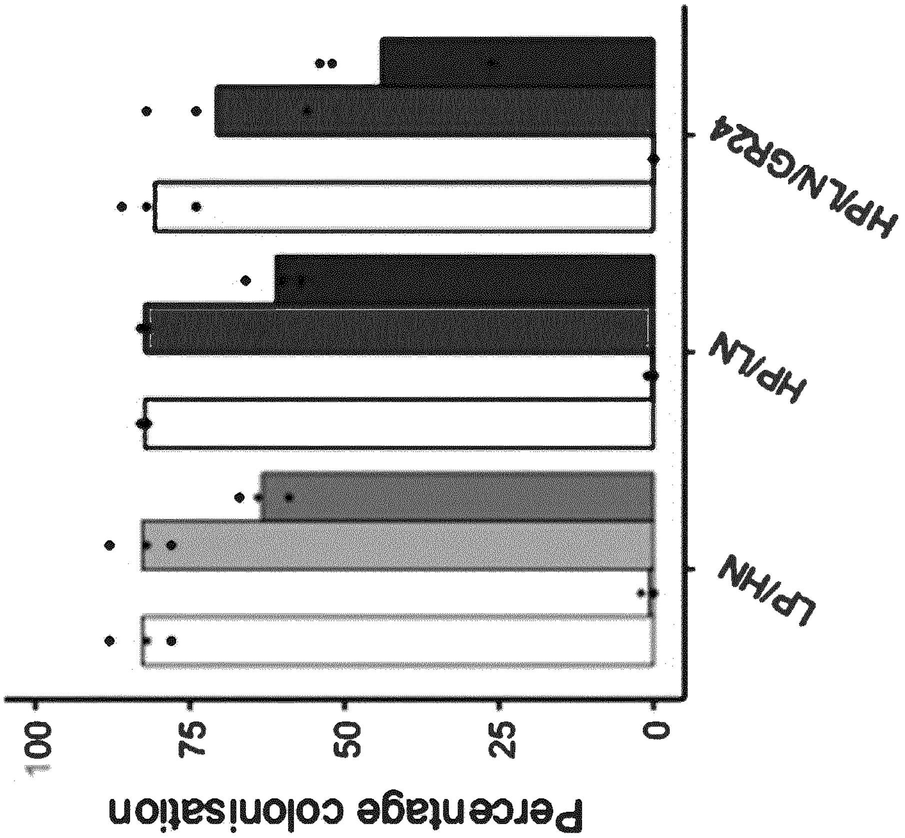
Figure 14D:
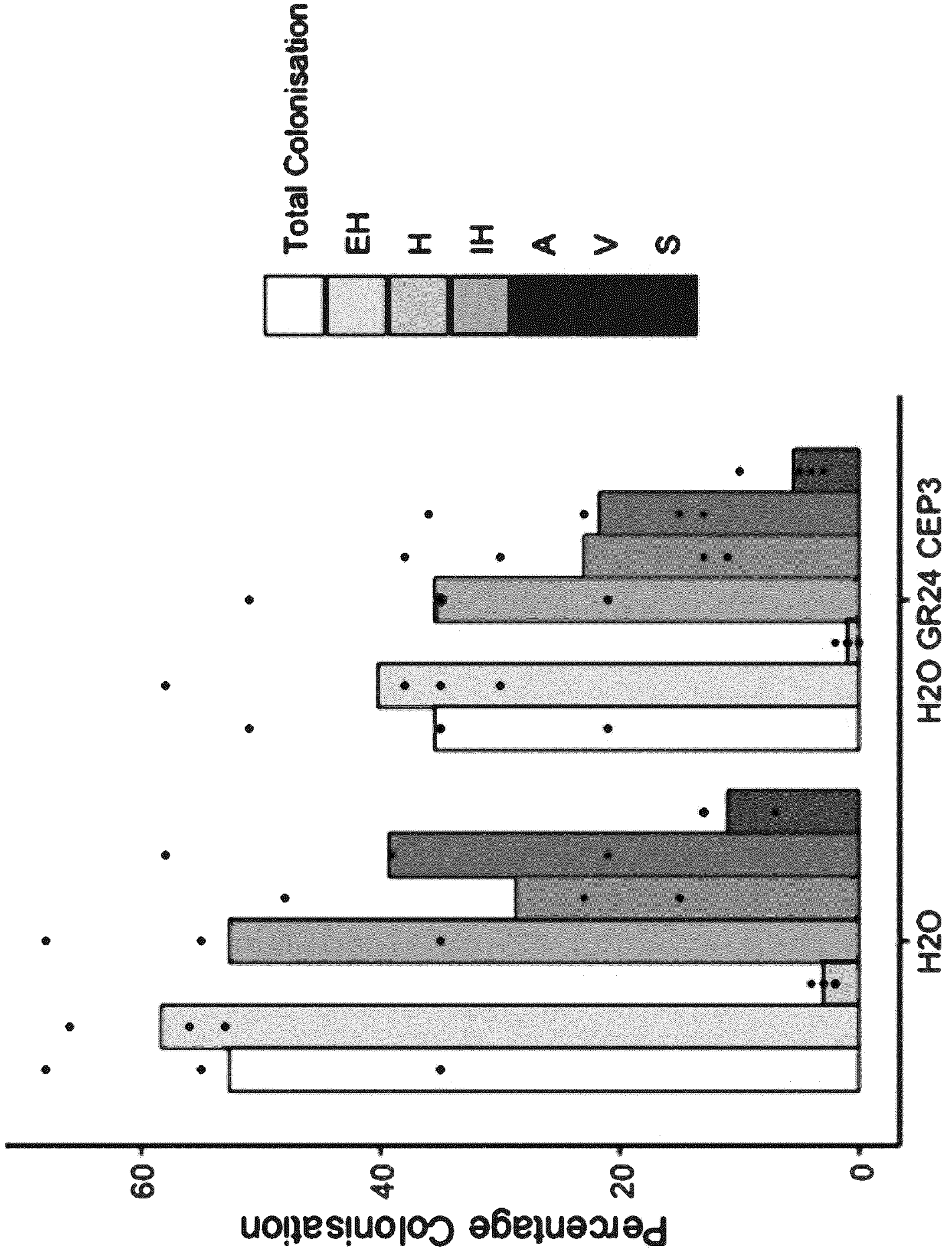

FIGS. 14A-14D provide the effects of treating *H. vulgare* plants with a strigolactone or with both a strigolactone and a CEP peptide. FIG. 14A shows traces of nuclear calcium oscillations produced by *H. vulgare* root epidermal cells. Plants were grown under high nitrate and high phosphate (5 mM $NO_3^-$ and 0.5 mM $PO_4^-$) and cells were treated with $10^{-7}$ M SmLCO. The top trace represents cells without any additional treatment, the middle trace represents cells that were pre-treated with 1 μM 5-deoxystrigol, and the bottom trace represents cells that were pre-treated with 1 μM 5-deoxystrigol and 1 μM CEP3. The scale bar indicates a span of 10 minutes, and the fractions indicate the number of cells that responded over the total number of cells analyzed. FIGS. 14B-14C provide the level of mycorrhizal colonization of *H. vulgare* when treated with the synthetic strigolactone analog GR24 under different nutrient conditions, as determined in two separate experiments. In FIG. 14B, colonization was measured 7 weeks post inoculation, and the x-axis indicates the nutrient conditions tested, and whether the plants were treated with GR24. LP indicates low phosphate (10 μM $PO_4^-$), HP indicates high phosphate (500 μM $PO_4^-$), LN indicates low nitrate (0.5 mM $NO_3^-$), and HN indicates high nitrate (3 mM $NO_3^-$). GR24 was applied twice a week at a concentration of 0.1 μM. In FIG. 14C, colonization was measured 6 weeks post inoculation, and the x-axis indicates the nutrient conditions tested, and whether the plants were treated with GR24. LP indicates low phosphate (10 μM $PO_4^-$), HP indicates high phosphate (500 μM $PO_4^-$), LN indicates low nitrate (0.5 mM $NO_3^-$), and HN indicates high nitrate (3 mM $NO_3^-$). GR24 was applied twice a week at a concentration of 0.1 μM, the grey p-value represents the result of Mann-Whitney statistical tests, and the black p-values and asterisks represent statistical significance as determined by a Kruskal-Wallis test. In FIGS. 14B-14C, the y-axis represents the percentage of roots colonized by mycorrhizal fungi, and the shading of each bar represents the fungal structure quantified. The lightest grey bars represent the total root colonization, and, from light to darkest grey, the other bars represent the hyphopodia, intraradical hyphae, and arbuscules. FIG. 14D shows the level of mycorrhizal colonization of *H. vulgare* treated with either water (H2O) or water with 0.1 μM of the synthetic strigolactone analog GR24 and 1 μM CEP3 (H2O GR24 CEP3) twice a week from the 3rd day after inoculation, as indicated on the x-axis. Colonization with the mycorrhizal fungus *R. irregularis* was measured 4 weeks post inoculation. The y-axis represents the percentage of roots colonized by mycorrhizal fungi, and the shading of each bar represents the fungal structure that was quantified. The lightest grey bars represent the total root colonization, and, from light to darkest grey, the other bars represent the external hyphae (EH), hyphopodia (H), internal hyphae (IH), arbuscules (A), vesicles (V), and spores (S).

Figure 15A:
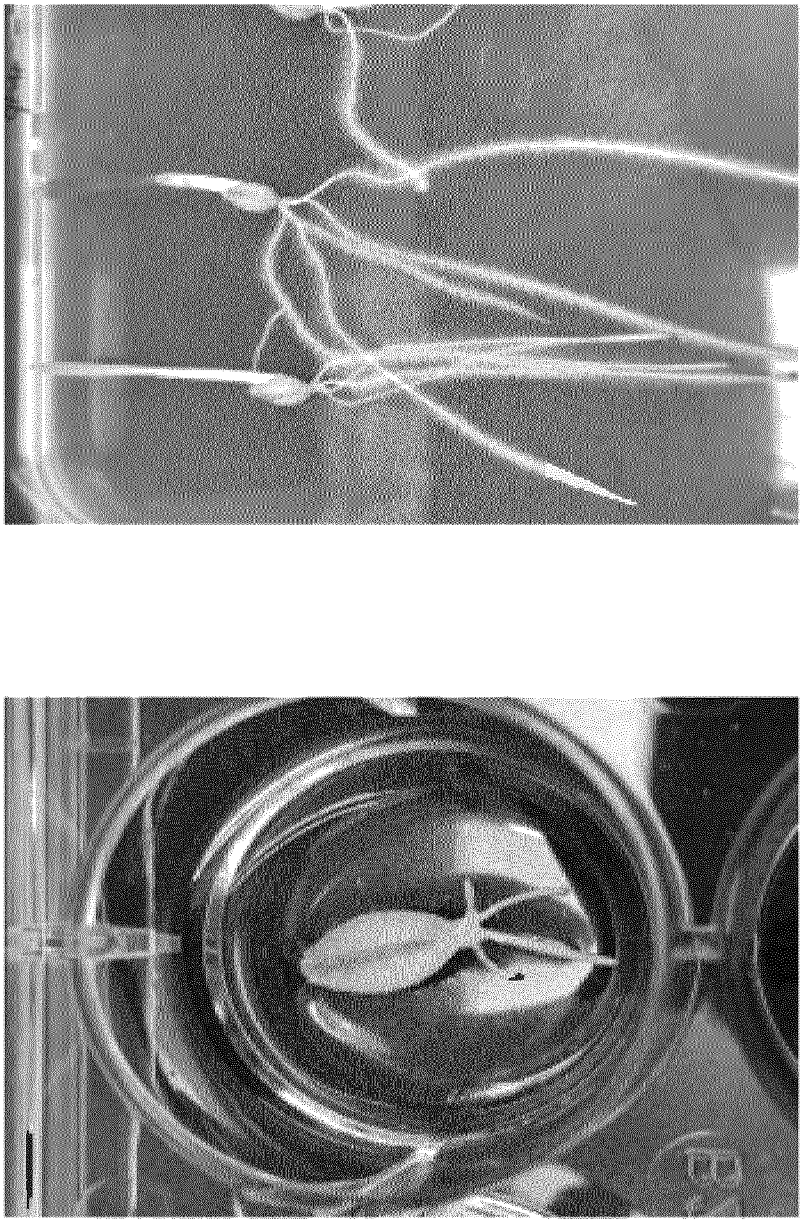
Figure 15B:
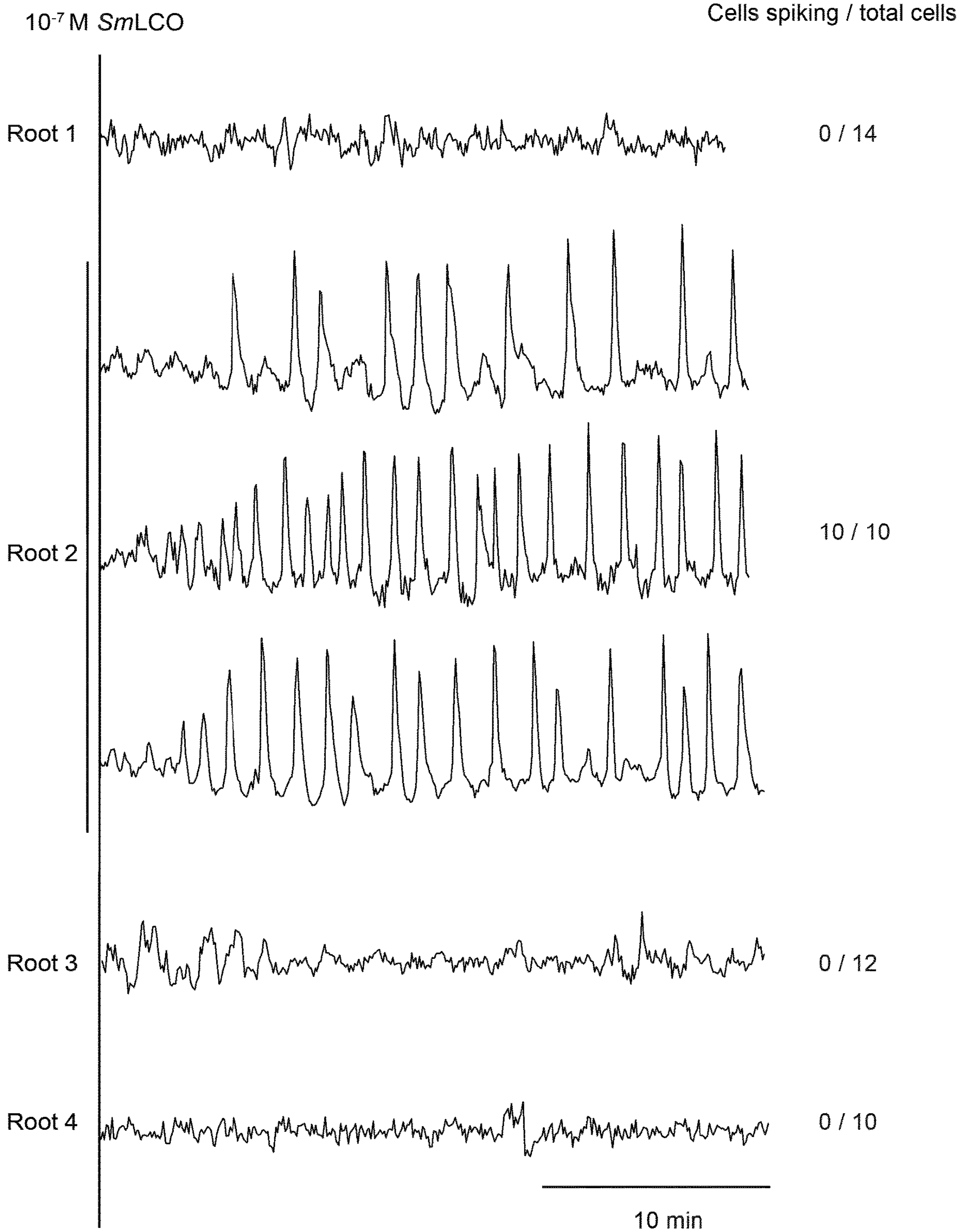

FIGS. 15A-15B provide an analysis of nuclear calcium oscillations produced by *H. vulgare* root epidermal cells of different roots of a *H. vulgare* seedling. FIG. 15A shows representative images of 1 day old *H. vulgare* (left) and 3 day old *H. vulgare* seedlings (right) with multiple roots that have emerged. FIG. 15B shows traces of nuclear calcium oscillations produced by *H. vulgare* root epidermal cells of four separate roots from a 3 day old seedling, as indicated on the left. The top trace is from Root 1, the next three traces down are from Root 2, the fifth trace down is from Root 3, and the bottom trace is from Root 4. Plants were grown under high nitrate and high phosphate (5 mM $NO_3^-$ and 0.5 mM $PO_4^-$). Roots were pre-treated with 1 μM strigolactone and 1 μM CEP3 for 12 hours, and secondarily treated with $10^{-7}$ M SmLCO. The scale bar indicates a span of 10 minutes, and the fractions indicate the number of cells that responded over the total number of cells analyzed.

Figure 16:
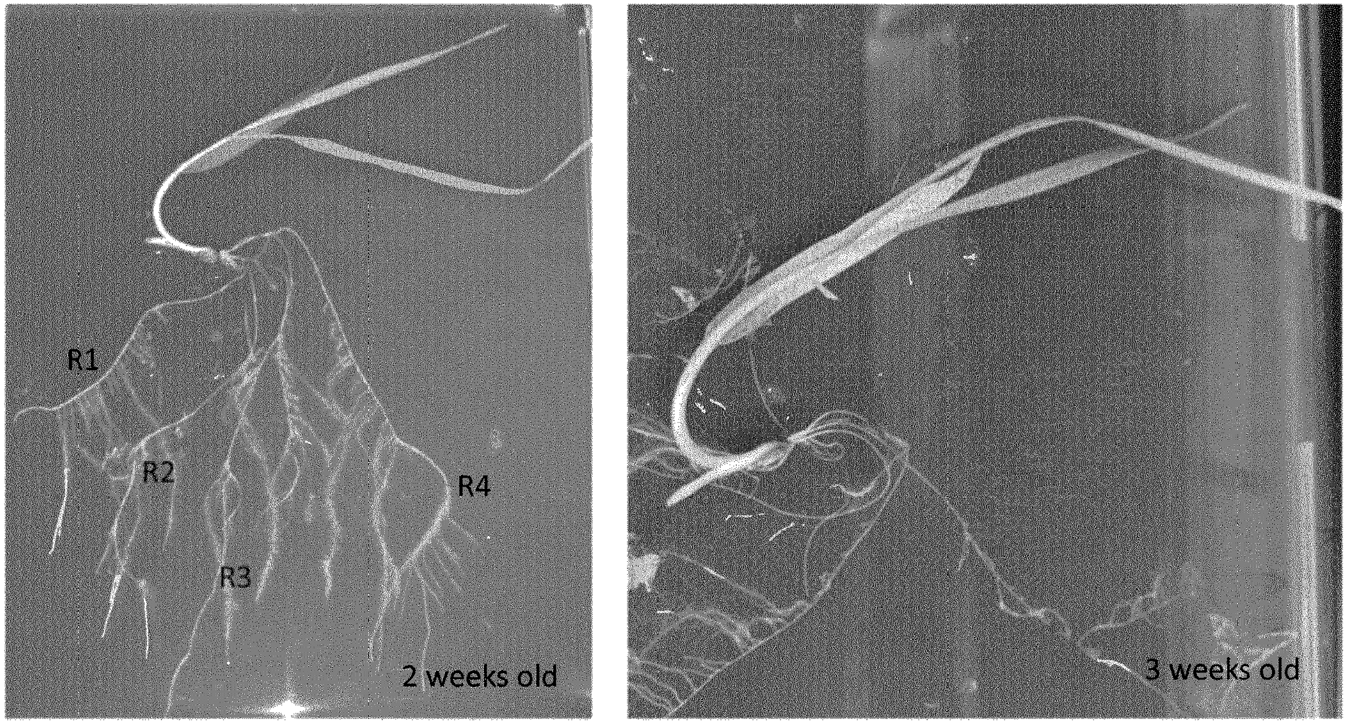

FIG. 16 shows an analysis of nuclear calcium oscillations produced by *H. vulgare* root epidermal cells of different roots of a *H. vulgare* seedling. Images of 2 week old *H. vulgare* (left bottom; individual roots labelled as R1, R2, R3, and R4) and 3 week old *H. vulgare* plants (right bottom) grown in limiting nitrate and phosphate (−N−P, 0 mM $NO_3^-$ and 0 mM $PO_4^-$) are shown, as well as a table (top middle) summarizing whether nuclear calcium oscillations ("spiking") were produced by the individual roots of the seedlings at the two time points (two weeks=14d; three weeks=21d).

Figure 17A:
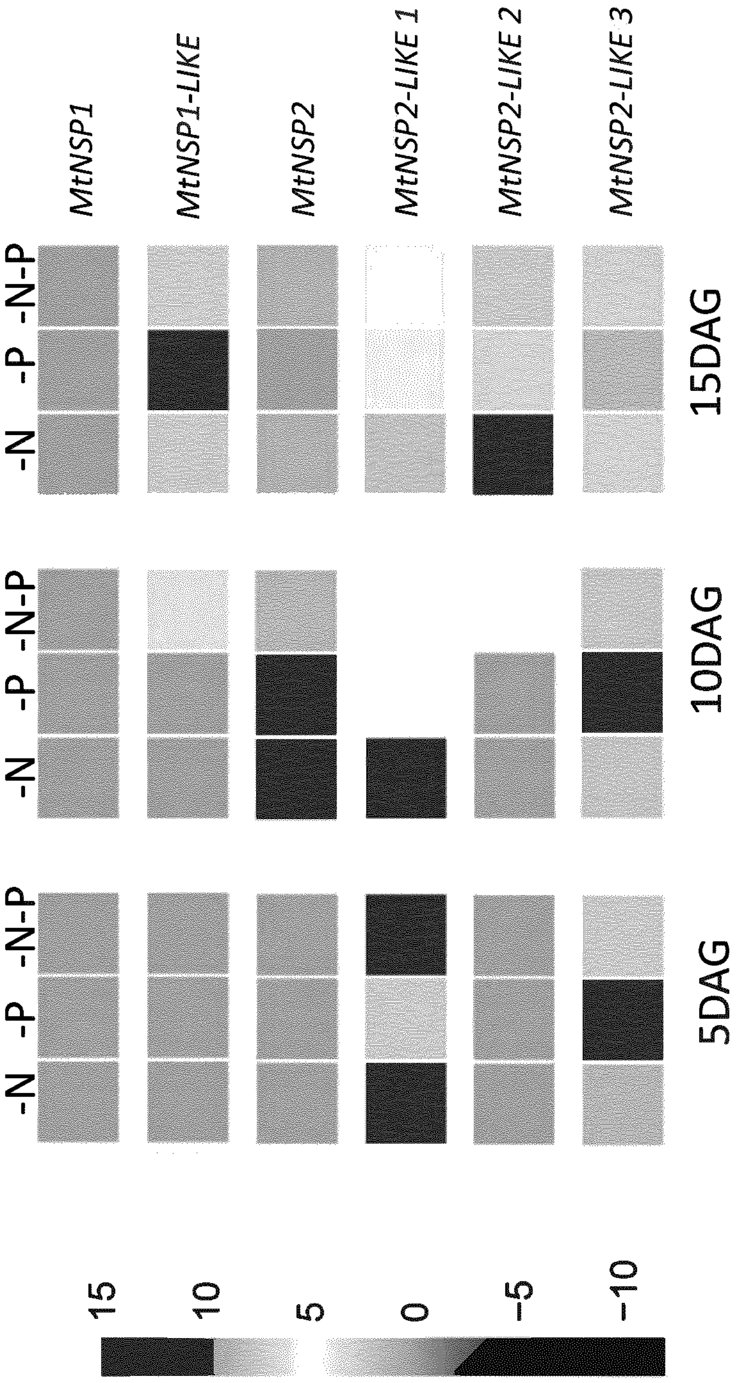

FIGS. 17A-17E provide the expression levels of NSP genes under different nutrient conditions, and the phylogenetic relationships of NSP homologs. FIG. 17A shows a heatmap showing the expression levels of *M. truncatula* genes under different nutrient conditions, as determined by RNA-seq. As indicated from left to right above the heat map, *M. truncatula* was grown under limiting nitrate (−N, 0 mM $NO_3^-$ and 3.75 mM $PO_4^-$), limiting phosphate (−P, 5 mM $NO_3^-$ and 0.0075 mM $PO_4^-$), or limiting nitrate and phosphate (−N−P, 0 mM $NO_3^-$ and 0.0075 mM $PO_4^-$). The relative expression level of each condition is normalized to expression when plants were grown under replete nitrate and replete phosphate (+N+P, 5 mM $NO_3^-$ and 3.75 mM $PO_4^-$). As indicated from left to right below the heatmap, expression was measured either 5, 10, or 15 days after germination ("DAG"). The scale on the left indicates the relative expression levels, with black representing the lowest expression and dark grey representing the highest expression.

Figure 17B:
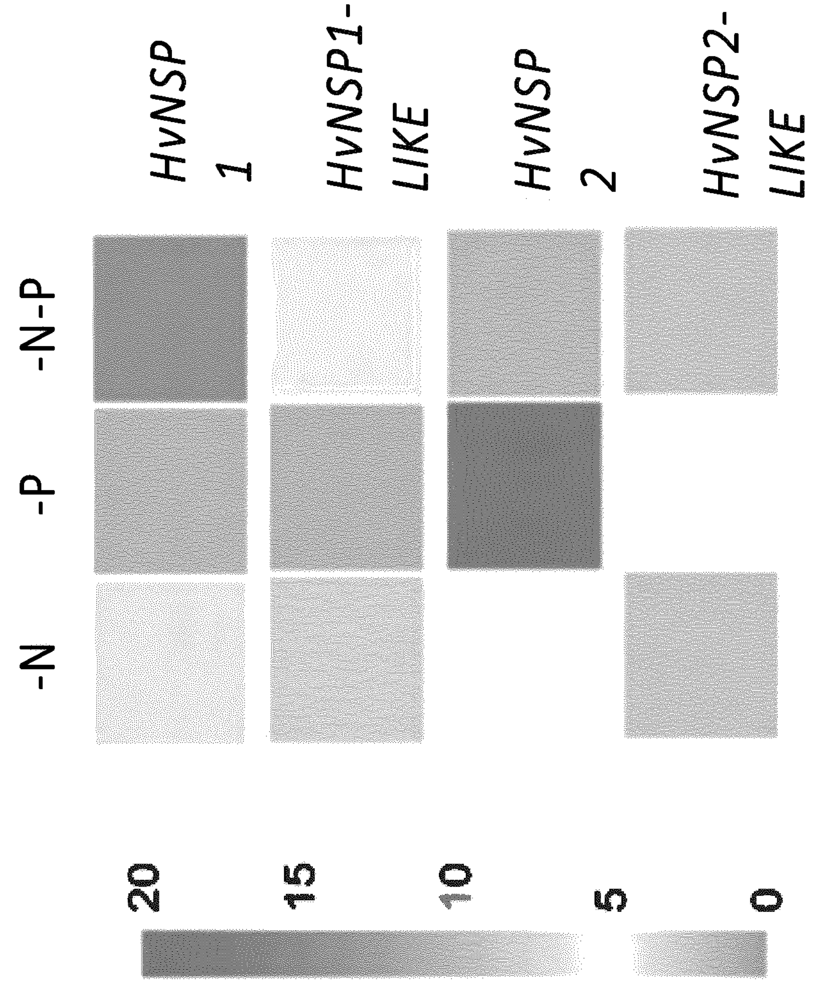
Figure 17C:
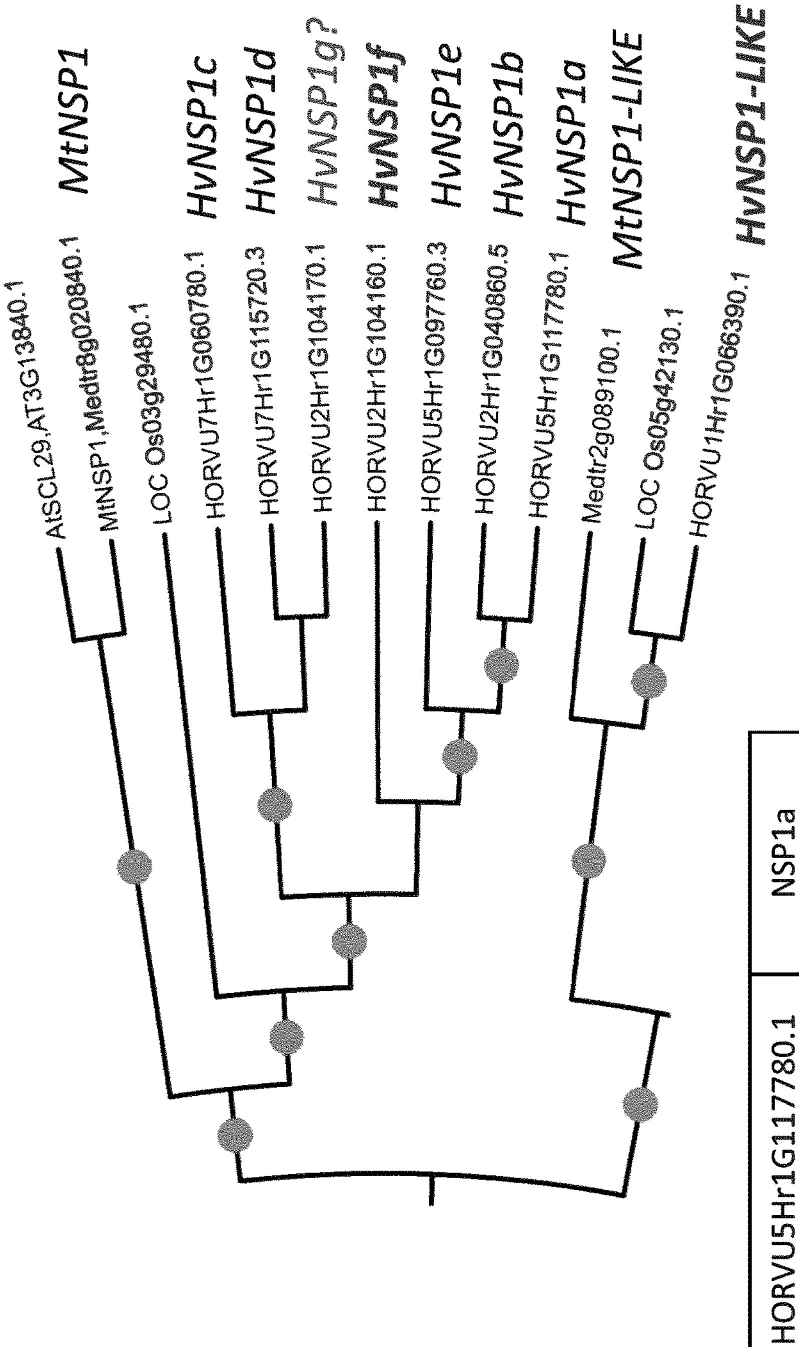
Figure 17D:
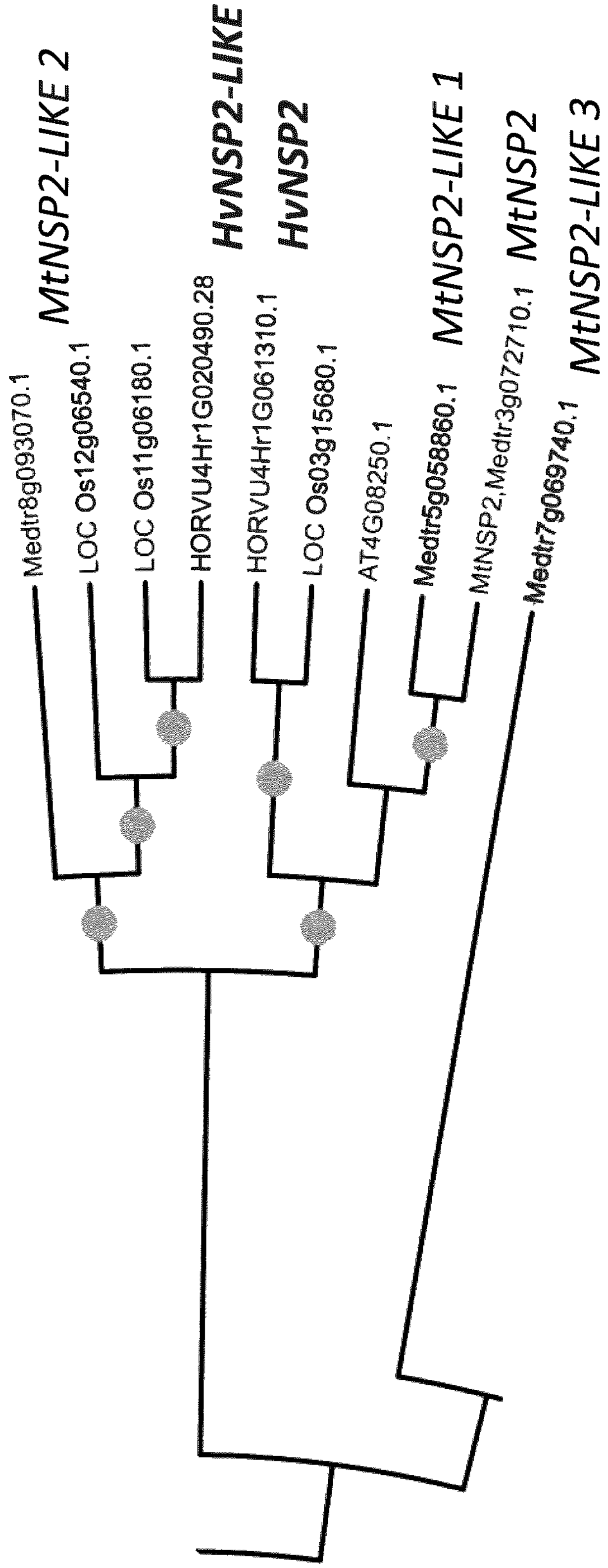
Figure 17E:
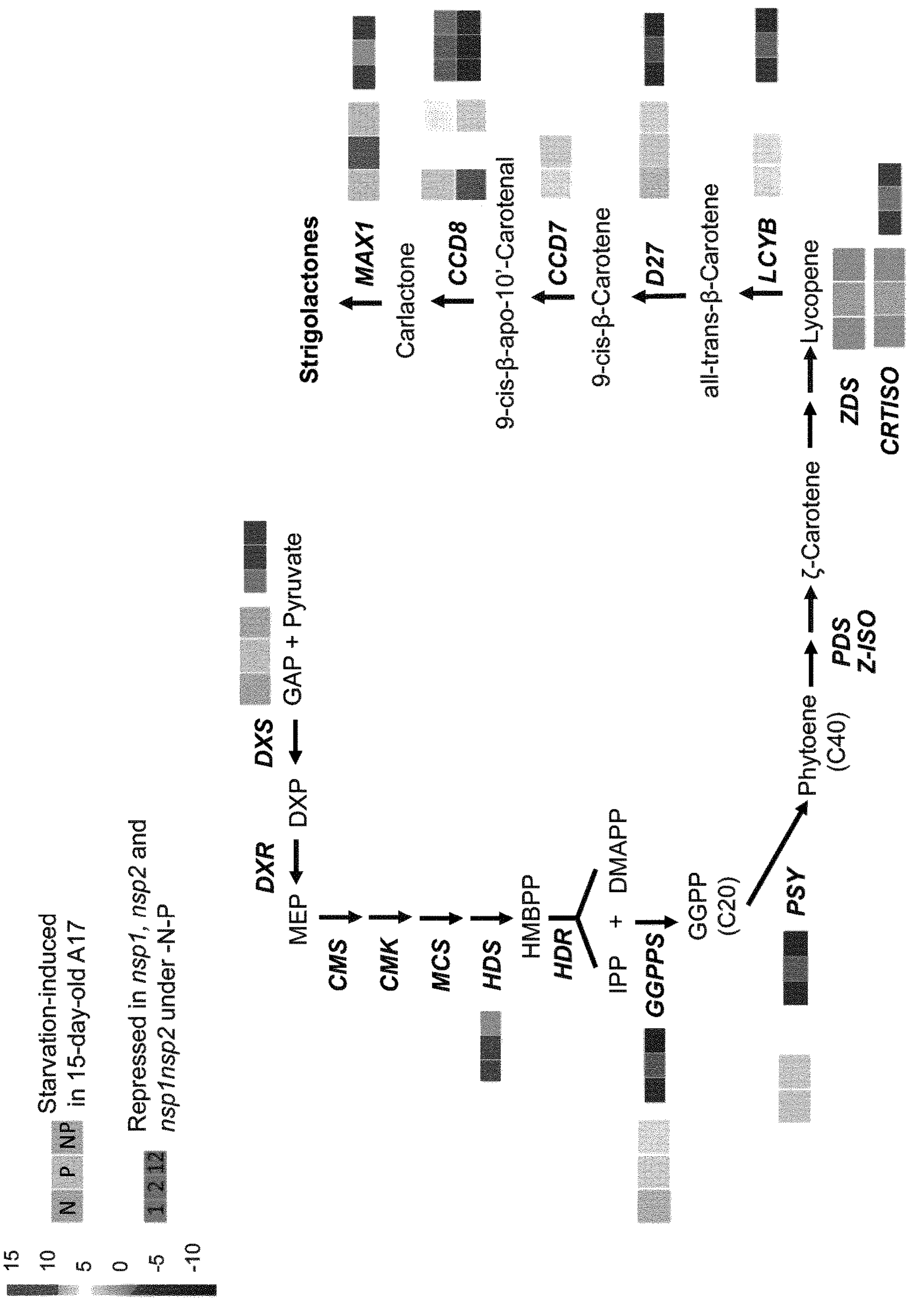

FIG. 17B provides a heatmap showing the expression levels of endogenous *H. vulgare* NSP genes under different nutrient conditions, as determined by RNA-seq. *H. vulgare* was grown in sand for 21 days and watered with the following nutrient conditions, as indicated from left to right above the heat map: limiting nitrate (−N, 0 mM $NO_3^-$ and 0.5 mM $PO_4^-$), limiting phosphate (−P, 5 mM $NO_3^-$ and 0 mM $PO_4^-$), or limiting nitrate and phosphate (−N−P, 0 mM $NO_3^-$ and 0 mM $PO_4^-$). The relative expression level of each condition is normalized to expression when plants were grown under replete nitrate and replete phosphate (+N+P, 5 mM $NO_3^-$ and 0.5 mM $PO_4^-$). The expression of HvNSP1, HvNSP1-LIKE, HvNSP2, and HvNSP2-LIKE was measured (labels on right). The scale indicates the relative expression levels, with light grey representing the lowest expression and dark grey representing the highest expression. FIG. 17C shows a gene tree of NSP1 homologs. MtNSP1 indicates *M. truncatula* NSP1, HvNSP1f indicates *H. vulgare* NSP1 (i.e., the closest homolog of *M. truncatula* NSP1), MtNSP1-LIKE indicates the *M. truncatula* NSP1-like gene, and HvNSP1-LIKE indicates the *H. vulgare* NSP1-like gene. Other *H. vulgare* homologs of NSP1 are also shown and labeled HvNSP1a through HvNSP1e, and HvNSP1g. Additionally included in the gene tree are AtSCL29 (indicates the *Arabidopsis thaliana* gene At3g13840.1), and LOC Os05g42130.1 and LOC Os03g29480.1 (both *Oryza sativa* genes). FIG. 17D shows a gene tree of NSP2 homologs. MtNSP2-LIKE 2 indicates a *M. truncatula* NSP2-like gene, HvNSP2-LIKE indicates the *H. vulgare* NSP2-like gene, HvNSP2 indicates *H. vulgare* NSP2, MtNSP2-LIKE 1 indicates another *M. truncatula* NSP2-like gene, MtNSP2 indicates *M. truncatula* NSP2, and MtNSP2-LIKE 3 indicates a third *M. truncatula* NSP2-like gene. Additionally included in the gene tree are the *A. thaliana* gene At4g08250.1, and LOC Os12g06540.1, LOC Os11g06180.1, and LOC Os03g15680.1 (three *Oryza sativa* genes). FIG. 17E shows a heatmap showing the expression levels of *M. truncatula* genes under different nutrient conditions or in different genetic backgrounds as determined by RNA-seq, mapped onto a schematic of strigolactone biosynthesis. Gene expression levels were measured under different nutrient conditions as described in FIG. 17A (relatively larger sets of three heatmap boxes, 15 day time point is shown), or in nsp1 and/or nsp2 mutant plants (relatively smaller sets of three heatmap boxes). The scale indicates the relative expression levels, with black representing the lowest expression and black representing the highest expression.

Figure 18:
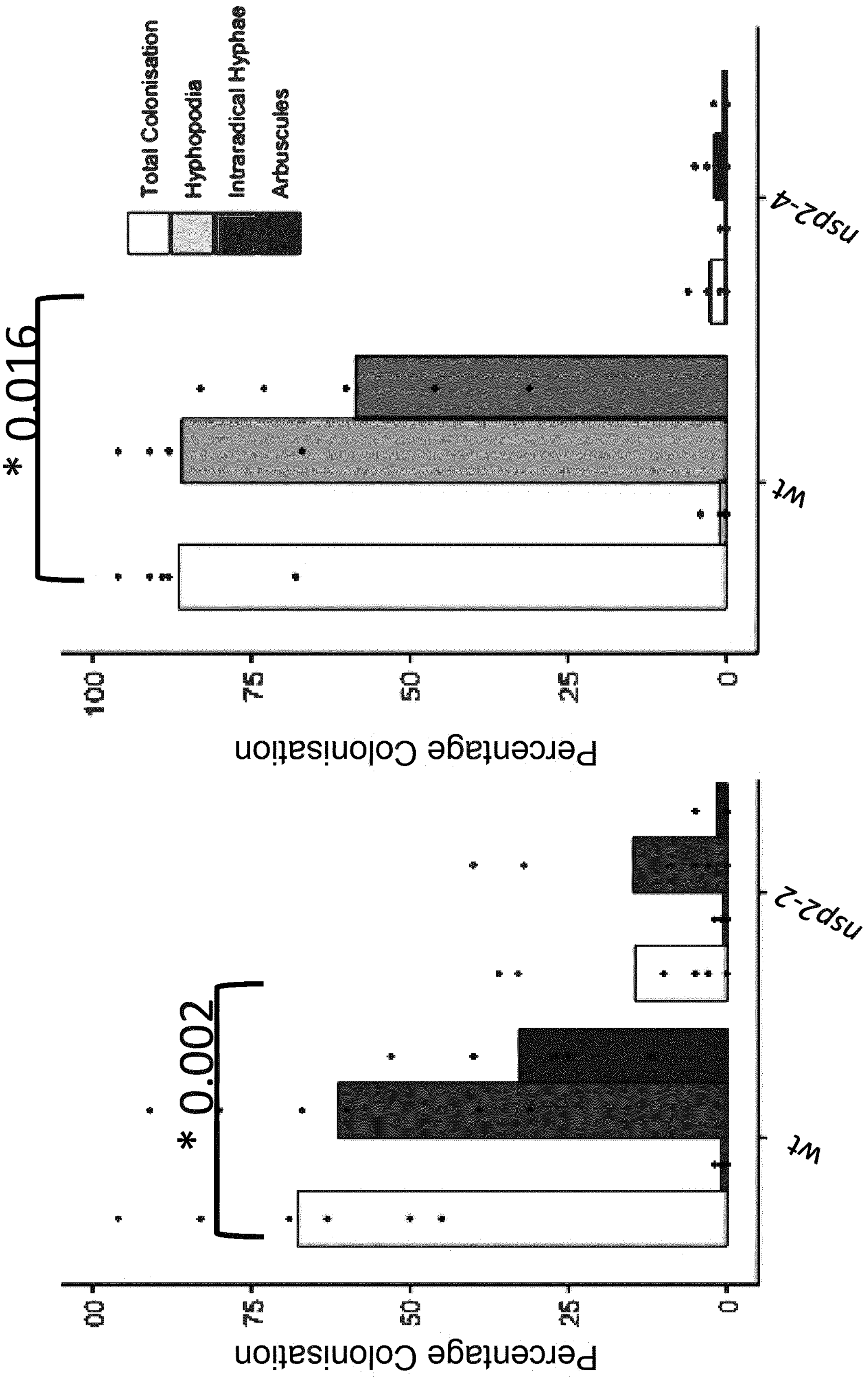

FIG. 18 provides the level of mycorrhizal colonization of wild type *H. vulgare* plants compared to *H. vulgare* plants with mutations in NSP2. As indicated on the x-axis, two independent mutations of NSP2 were tested, with nsp2-2 compared to wild type shown on the left, and nsp2-4 compared to wild type on the right. The y-axis represents the percentage of roots colonized by mycorrhizal fungi, and the shading of each bar represents the fungal structure that was quantified. P-values indicated are the result of a Mann-Whitney test. The lightest grey bars represent the total root colonization, and, from light to darkest grey, the other bars represent the hyphopodia, intraradical hyphae, and arbuscules.

Figure 19A:
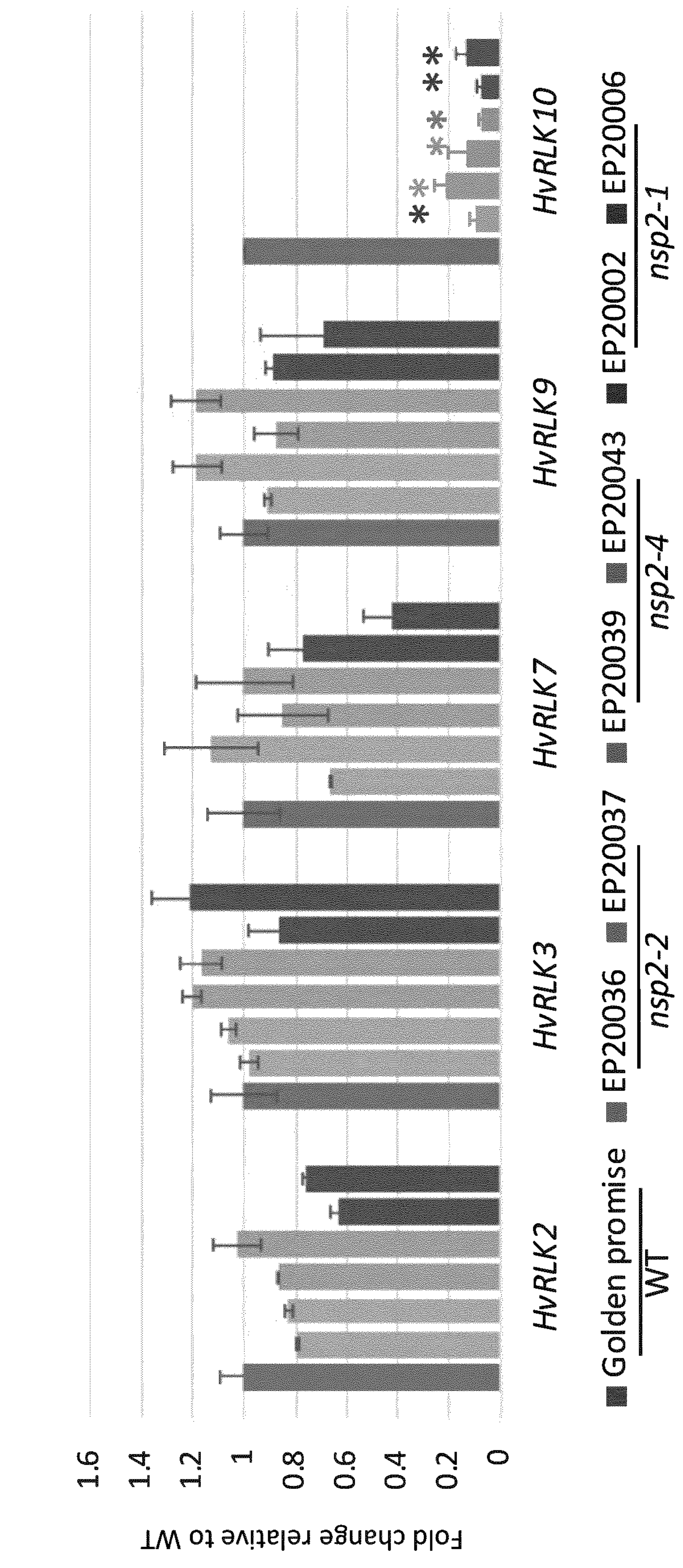
Figure 19B:
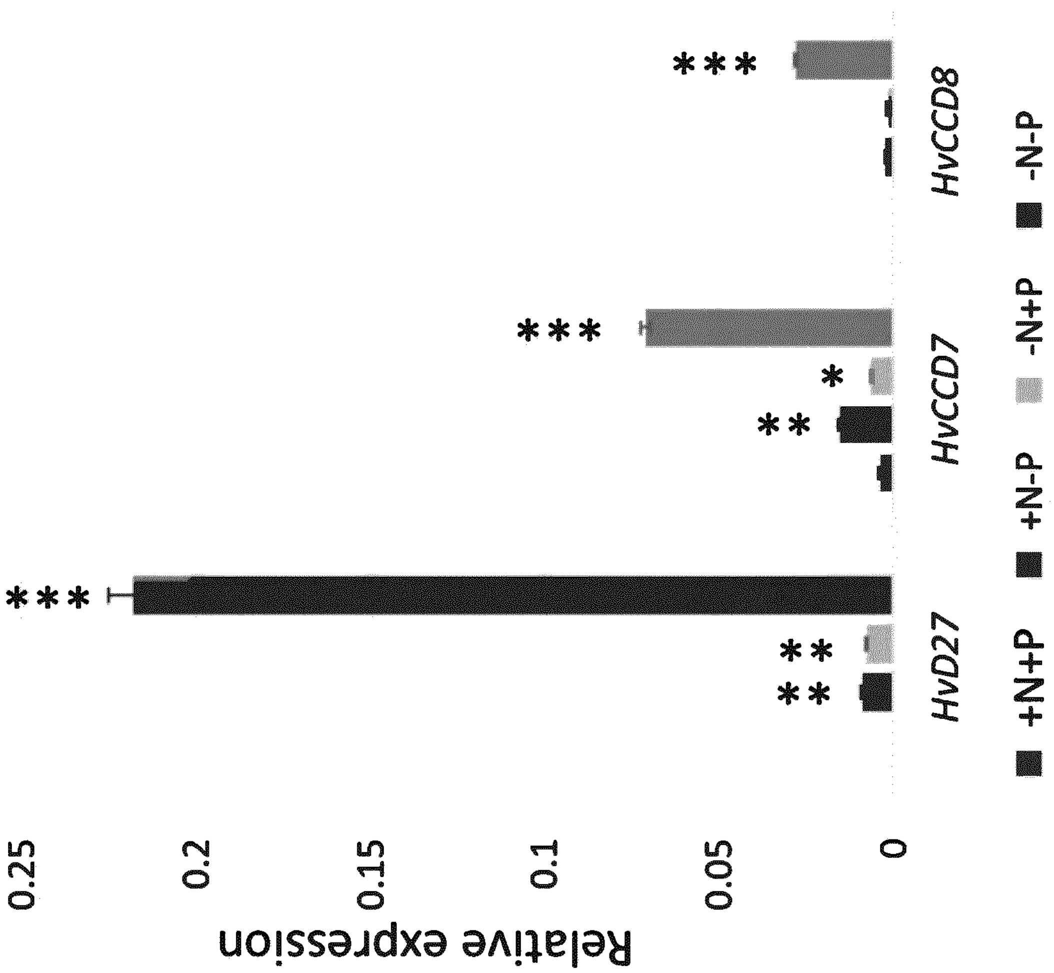
Figure 19C:
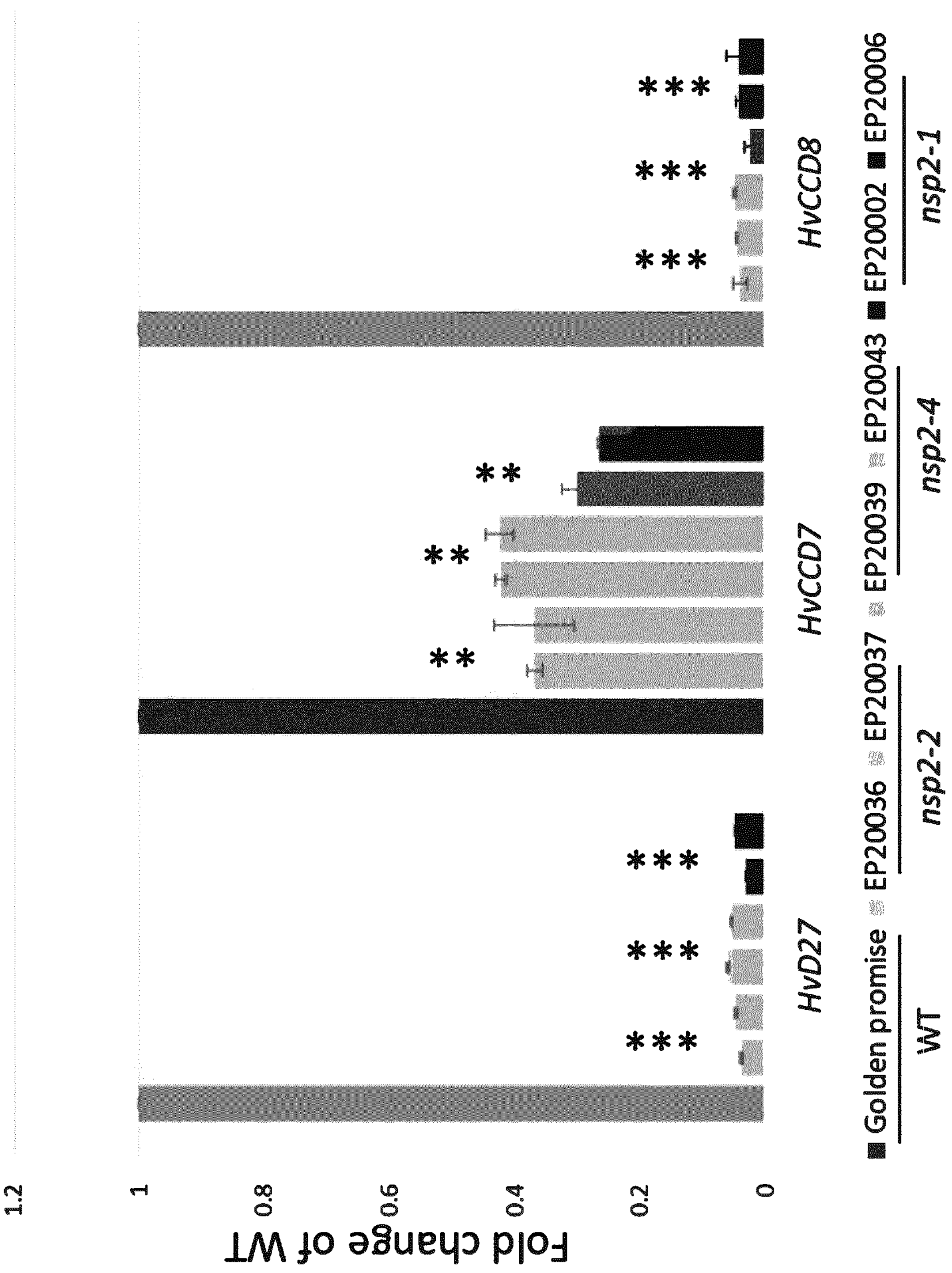

FIGS. 19A-19C provide the effect of mutating *H. vulgare* NSP2 and/or growing plants under different nutrient conditions on gene expression levels. FIG. 19A shows expression levels of *H. vulgare* LysM receptor-like kinase genes, as indicated on the x-axis including, from left to right, HvRLK2, HvRLK3, HvRLK7, HvRLK9, and HvRLK10. Relative expression levels (i.e., fold changes relative to wild type expression) are shown on the y-axis. Expression from wild type *H. vulgare* (*H. vulgare* cv. Golden Promise) is shown in dark grey (leftmost bar in each group), nsp2-2 is shown in lighter gray (second and third from left bars in each group), nsp2-4 is shown in grey (fourth and fifth from left bars in each group), and nsp2-1 is shown in dark grey (second from right and rightmost bar in each group). nsp2-2, nsp2-4 and nsp2-1 are three independent mutant lines. In particular, EP20036 and EP20037 are two T3 lines originating from the same T2 plants (nsp2-2), EP20039 and EP20043 are two T3 lines originating from the same T2 plants (nsp2-4), and EP20002 and EP20006 are two T3 lines originating from the same T2 lines (nsp2-1). Plants were grown under limiting nitrate and phosphate (0 mM $NO_3^-$ and 0 mM $PO_4^-$) for 10 days, and whole roots were then collected for RNA expression analysis. FIGS. 19B-19C show expression levels of *H. vulgare* strigolactone biosynthetic genes. FIG. 19B shows the expression level of, from left to right along the x-axis, HvD27, HvCCD7, and HvCCD8 (primers for RT-qPCR did not differentiate between HvCCD8 copy one (chr3Hg0246861) and HvCCD8 copy two (chr3Hg0309501)). The y-axis indicates relative expression levels. *H. vulgare* was grown under either replete nitrate and replete phosphate (+N+P, 5 mM $NO_3^-$ and 0.5 mM $PO_4^-$, grey bars), replete nitrate and limiting phosphate (+N−P, 5 mM $NO_3^-$ and 0 mM $PO_4^-$, dark grey bars), limiting nitrate and replete phosphate (−N+P, 0 mM $NO_3^-$ and 0.5 mM $PO_4^-$ light grey bars), or limiting nitrate and limiting phosphate (−N−P, 0 mM $NO_3^-$ and 0 mM $PO_4^-$ grey bars), shown from left to right in each group. FIG. 19C shows the expression level of, from left to right along the x-axis, HvD27, HvCCD7, and HvCCD8 (primers for RT-qPCR did not differentiate between HvCCD8 copy one (chr3Hg0246861) and HvCCD8 copy two (chr3Hg0309501)). Relative expression levels (i.e., fold changes relative to wild type expression) are shown on the y-axis. Expression from wild type *H. vulgare* (*H. vulgare* cv. Golden Promise) is shown in grey (leftmost bar in each group), nsp2-2 is shown in lighter grey (second and third from left bars in each group), nsp2-4 is shown in grey (fourth and fifth from left bars in each group), and nsp2-1 is shown in dark grey (second from right and rightmost bar in each group). In FIGS. 19B-19C, values shown are the mean of three samples±SD, * indicates $P<0.001$,  indicates $P<0.01$, and * indicates $0.01<P<0.05$, as determined by a Student's t-test.

Figure 20A:
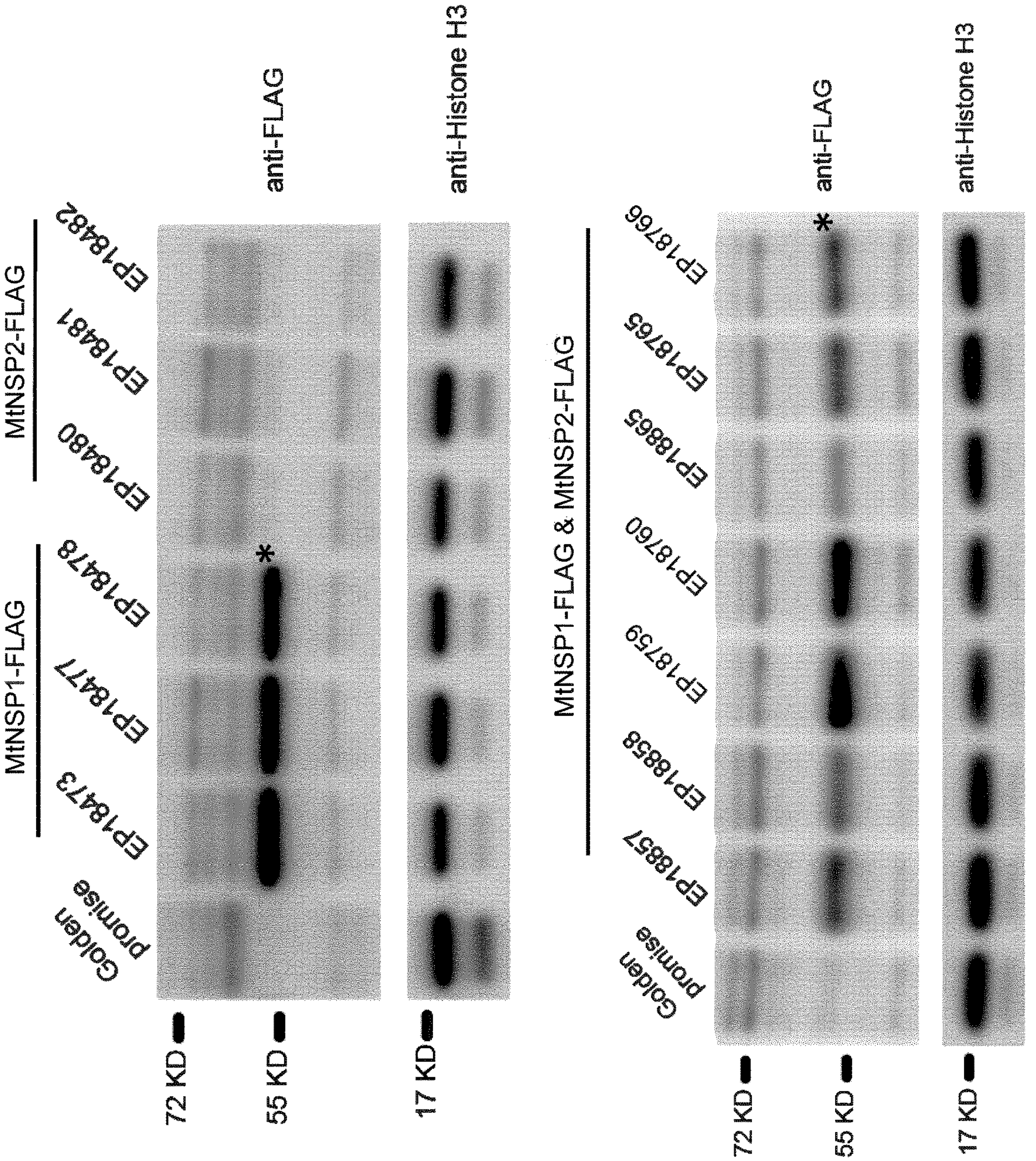
Figure 20B:
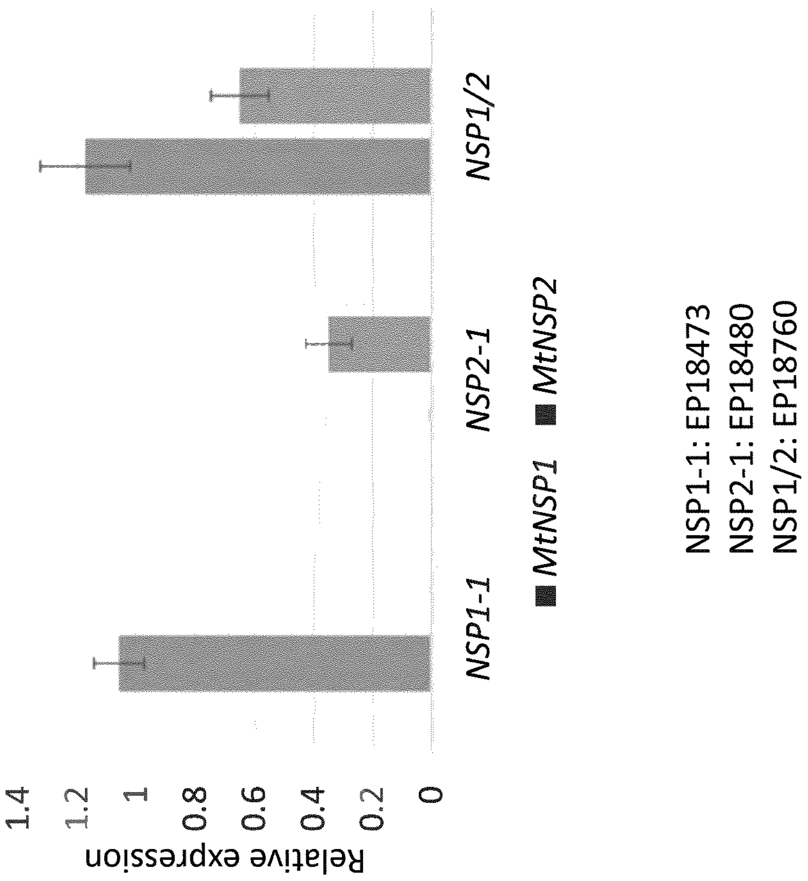
Figure 20C:
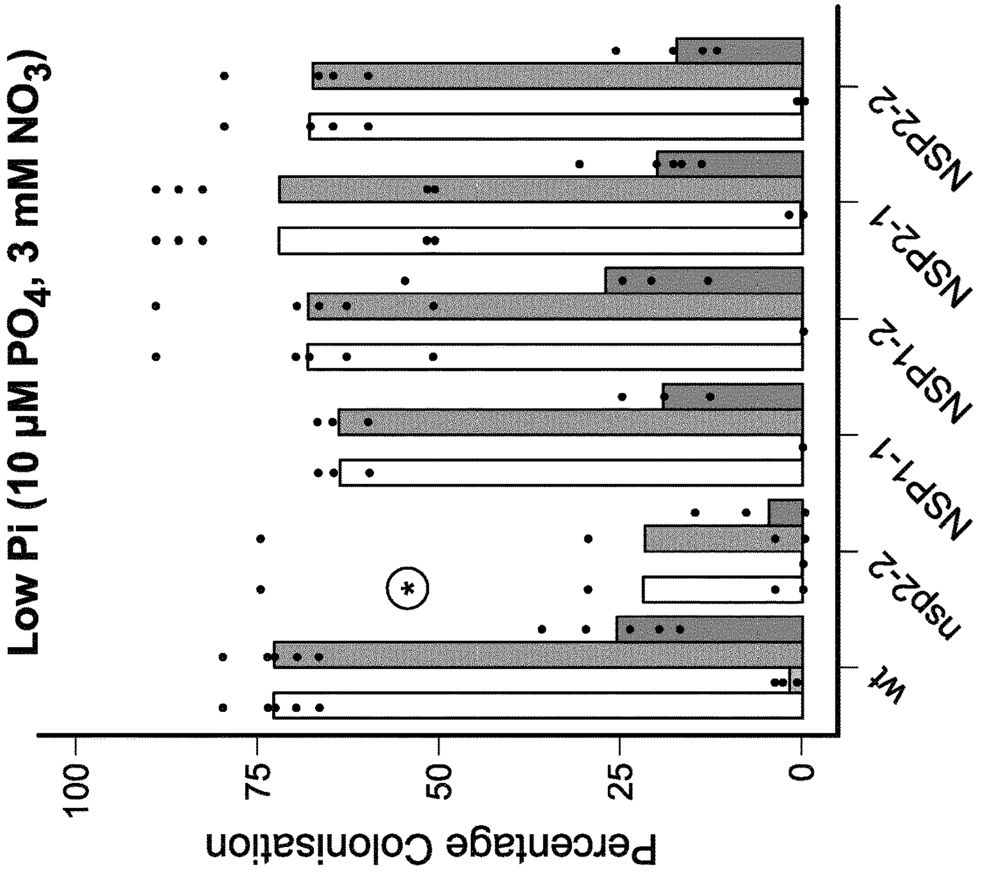
Figure 20D:
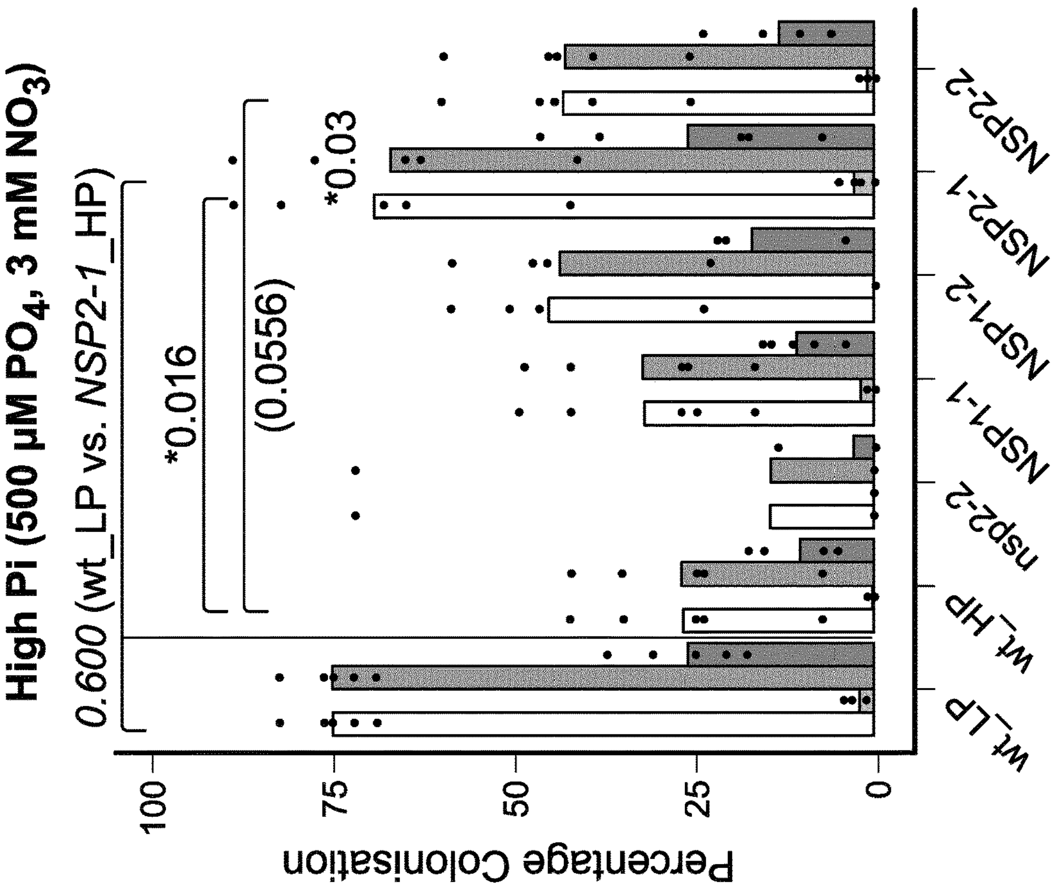

FIGS. 20A-20I provide data related to the engineering of NSPs in *H. vulgare*. FIG. 20A provides Western blots showing the detection of FLAG-tagged *M. truncatula* NSP1 and/or NSP2 overexpressed in *H. vulgare*. The top gel shows anti-FLAG blots from, from left to right, wild type *H. vulgare* ("Golden promise"), three isolates of *H. vulgare* with *M. truncatula* NSP1-FLAG, and three isolates of *H. vulgare* with *M. truncatula* NSP2-FLAG. An anti-histone $H_3$ blot is shown below as a loading control. The asterisk indicates NSP1-FLAG. The bottom gel shows anti-FLAG blots from, from left to right, wild type *H. vulgare* ("Golden promise"), and 7 isolates of *H. vulgare* with both *M. truncatula* NSP1-FLAG and NSP2-FLAG. An anti-histone $H_3$ blot is shown below as a loading control. The asterisk indicates NSP1-FLAG. FIG. 20B shows the expression of *M. truncatula* NSP1 and/or NSP2 in *H. vulgare* lines EP18473 (NSP1 overexpressed), EP18480 (NSP2 overexpressed) and EP18760 (NSP1 and NSP2 overexpressed). In FIG. 20C, plants were grown under low phosphate levels ("low Pi", 10 μM $PO_4^-$), colonization was measured 7 weeks post inoculation, and the x-axis indicates the genotype of *H. vulgare* tested, with "wt" indicating wild type, nsp2-2 indicating plants mutant in NSP2, NSP1-1 indicating one isolate of *H. vulgare* overexpressing *M. truncatula* NSP1, NSP1-2 indicating a second isolate of *H. vulgare* overexpressing *M. truncatula* NSP1, NSP2-1 indicating one isolate of *H. vulgare* overexpressing *M. truncatula* NSP2, and NSP2-2 indicating a second isolate of *H. vulgare* overexpressing *M. truncatula* NSP2. The circled asterisk represents statistical significance as determined by a Kruskal-Wallis test. In FIG. 20D, plants were grown under low phosphate levels ("LP", 10 μM $PO_4^-$, as indicated on the x-axis for "wt_LP" wild type sample to the left of the light grey bar) or high phosphate levels "HP", 500 μM $PO_4^-$ as indicated on the x-axis for the "wt HP" wild type sample to the right of the light grey bar; all other genotypes were grown at high phosphate levels as well ("high Pi")), colonization was measured 7 weeks post inoculation, and the x-axis indicates the genotype of *H. vulgare* tested, with "wt" indicating wild type, nsp2-2 indicating plants mutant in NSP2, NSP1-1 indicating one isolate of *H. vulgare* overexpressing *M. truncatula* NSP1, NSP1-2 indicating a second isolate of *H.*

Figure 20F:
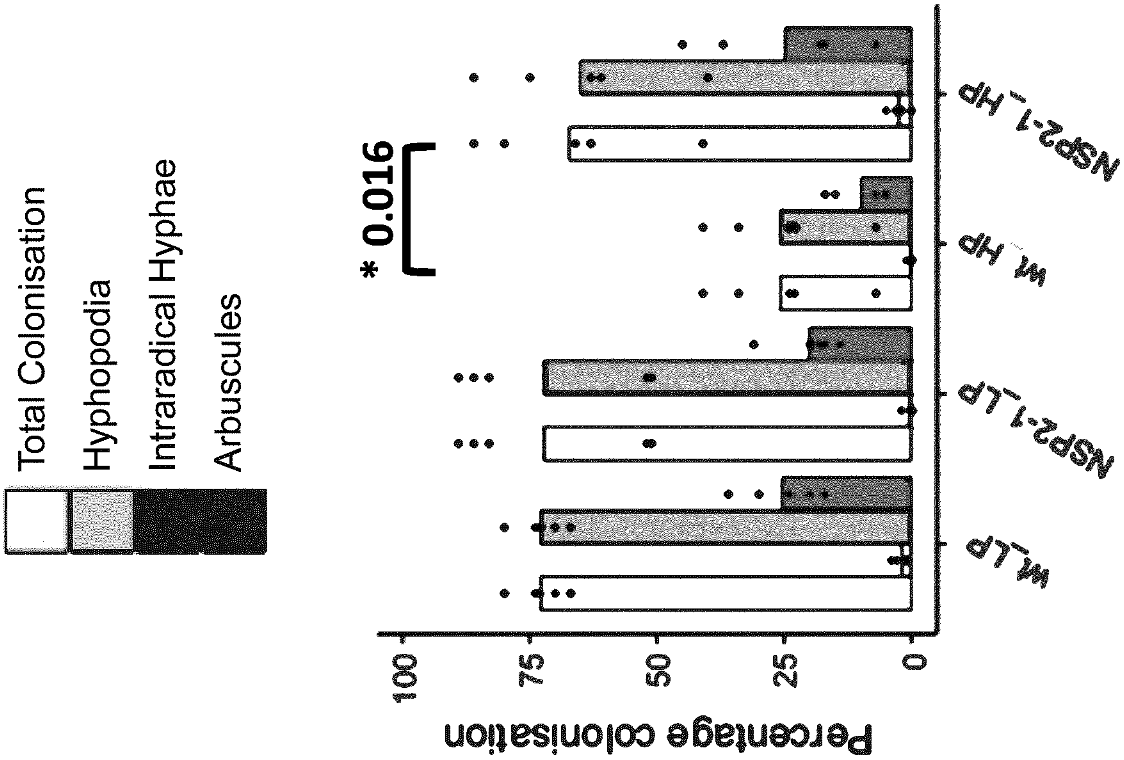
Figure 20E:
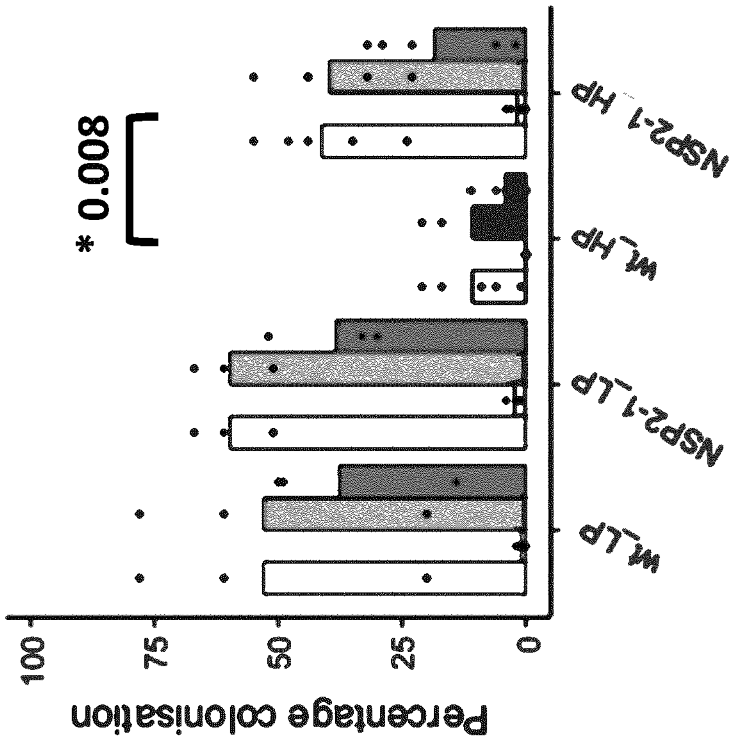
Figure 20G:
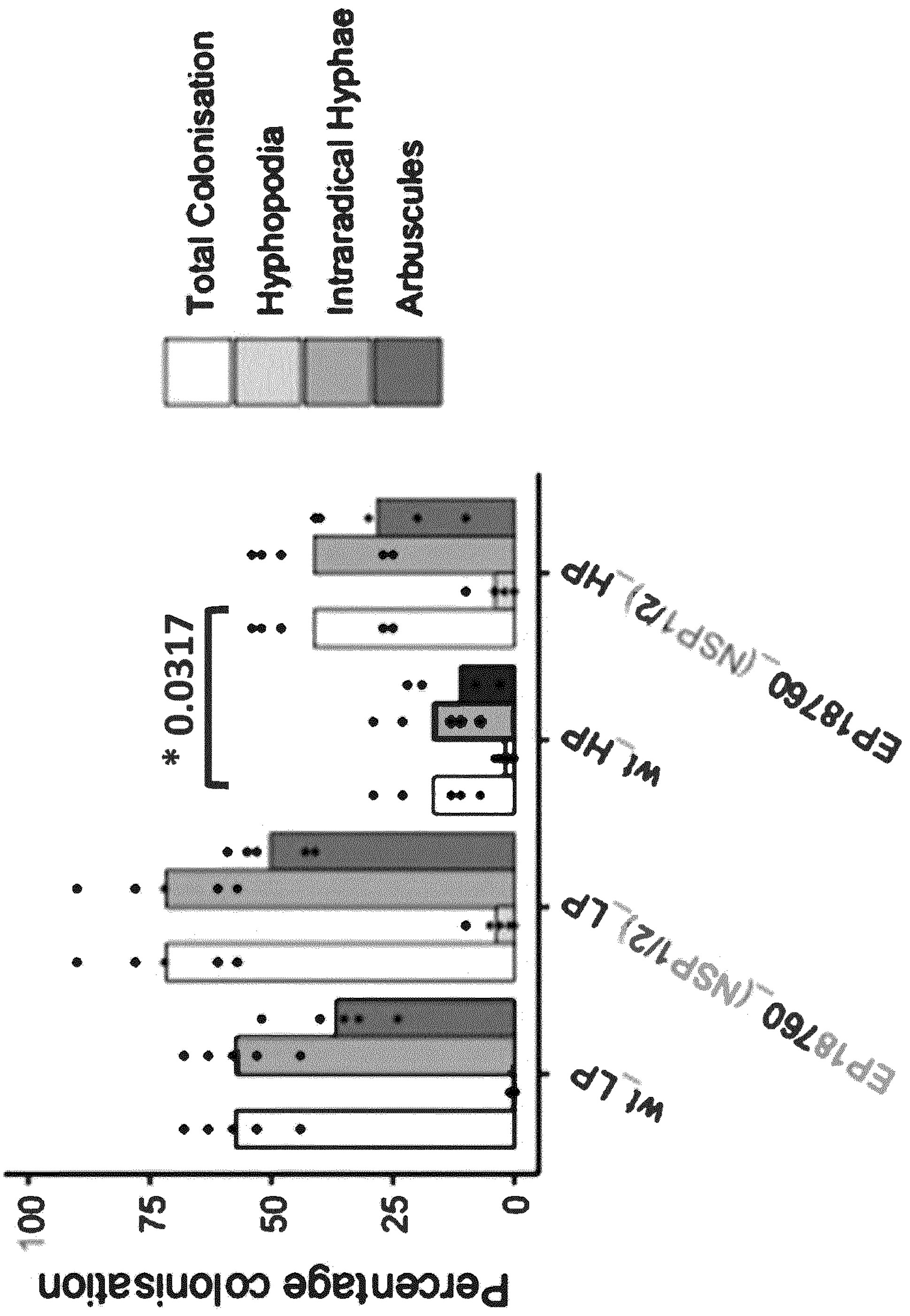
Figure 20H:
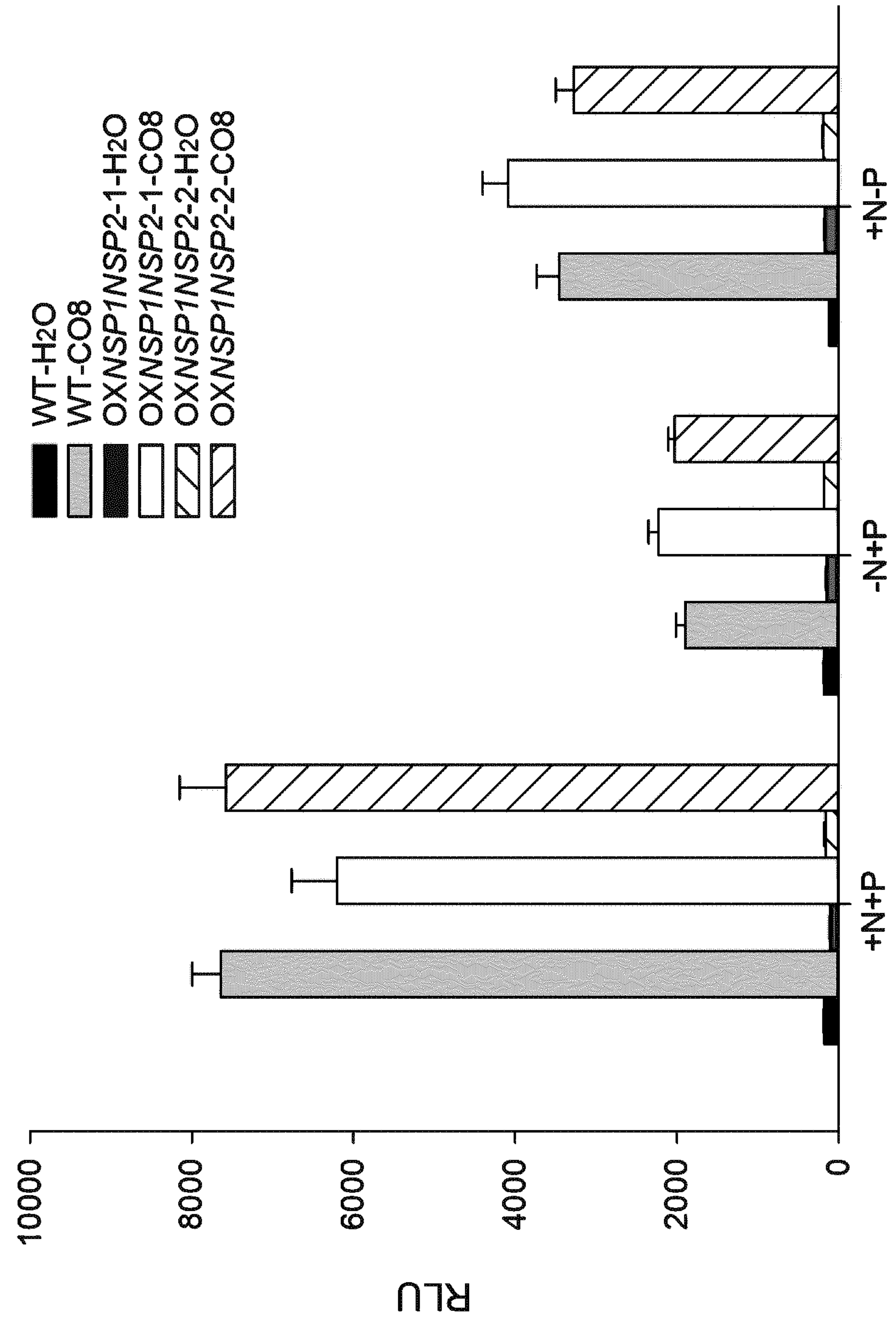
Figure 20I:
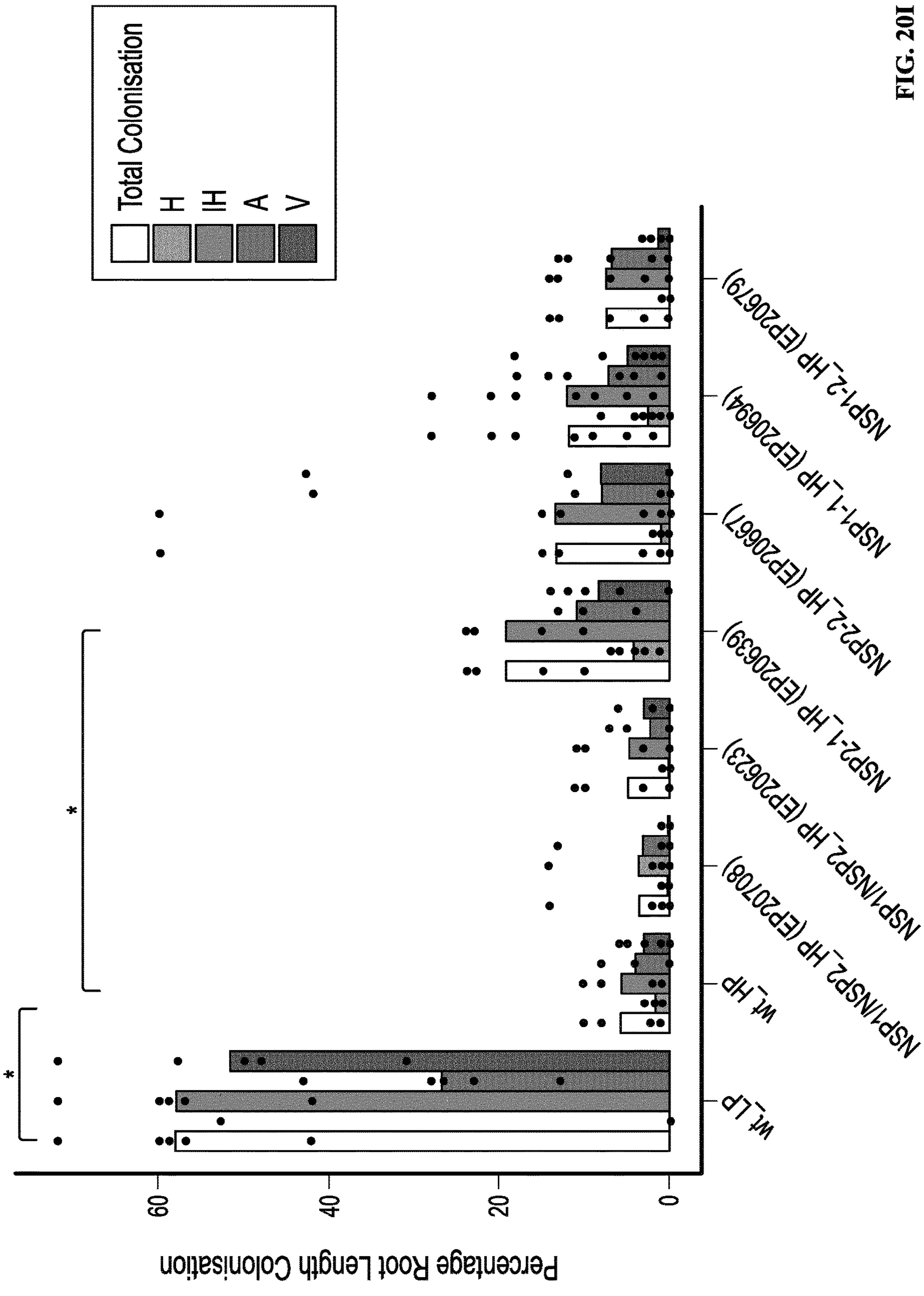

*vulgare* overexpressing *M. truncatula* NSP1, NSP2-1 indicating *H. vulgare* overexpressing *M. truncatula* NSP2, and NSP2-2 indicating a second isolate of *H. vulgare* overexpressing *M. truncatula* NSP2. As shown in light grey, a Mann-Whitney statistical test was performed to assess the difference between wild type in low phosphate vs. NSP2-1 in high phosphate, and no significant difference was found (P=0.600). As shown in grey, a Mann-Whitney statistical test was performed to assess the difference between wild type in high phosphate, and NSP2 mutants in high phosphate; NSP2-1 was statistically significantly different from wild type at P=0.016. The black asterisk and P-value (P=0.03) represents statistical significance as determined by a Kruskal-Wallis test. In FIG. 20E, plants were grown under 3 mM $NO_3^-$ and either low phosphate levels or high phosphate levels ("LP", 10 μM $PO_4^-$, or "HP", 500 μM $PO_4^-$, respectively, as indicated on the x-axis), and colonization was measured 5 weeks post inoculation. The x-axis indicates the genotype of *H. vulgare* tested, with "wt" indicating wild type, and NSP2-1 indicating *H. vulgare* overexpressing *M. truncatula* NSP2. The black p-values represent the results of Mann-Whitney statistical tests. In FIG. 20F, plants were grown under 3 mM $NO_3^-$ and either low phosphate levels or high phosphate levels ("LP", 10 μM $PO_4^-$, or "HP", 500 μM $PO_4^-$, respectively, as indicated on the x-axis), and colonization was measured 7 weeks post inoculation. The x-axis indicates the genotype of *H. vulgare* tested, with "wt" indicating wild type, and NSP2-1 indicating *H. vulgare* overexpressing *M. truncatula* NSP2. The black p-value represents the result of a Mann-Whitney statistical test. In each of FIGS. 20C-20F, plants were grown under 3 mM $NO_3$, the y-axis represents the percentage of roots colonized by mycorrhizal fungi, and the shading of each bar represents the fungal structure that was quantified. The lightest grey bars represent the total root colonization, and, from light to darkest grey, the other bars represent the hyphopodia, intraradical hyphae, and arbuscules. FIG. 20G shows the effect of overexpressing both NSP1 and NSP2 transcription factors in *H. vulgare* on mycorrhizal colonization by *R. irregularis* under different nutrient conditions. Colonization levels were measured 5 weeks post inoculation, and the x-axis indicates the genotype of *H. vulgare* tested, with "wt" indicating wild type, and NSP1/2 indicating plants with both NSP1 and NSP2 overexpressed. Plants were grown under 3 mM $NO_3$, and the x-axis also indicates the nutrient conditions tested, with LP indicating low phosphate (10 μM $PO_4^-$) and HP indicating high phosphate (500 μM $PO_4^-$). In FIG. 20G, the y-axis represents the percentage of roots colonized by mycorrhizal fungi, and the shading of each bar represents the fungal structure that was quantified. The lightest grey bars represent the total root colonization, and, from light to darkest grey, the other bars represent the hyphopodia, intraradical hyphae, and arbuscules. FIG. 20H shows the effect of overexpressing *M. truncatula* NSP1 and NSP2 in *H. vulgare* on reactive oxygen species formation under different growth conditions and treatments. Wild type (WT) or NSP overexpressing plants were treated with either water ($H_2O$) or $10^{-7}$ M CO8. Black bars indicate wild type plants treated with water, light gray bars indicate wild type plants treated with CO8, dark gray bars indicate NSP1 and NSP2 overexpressing plants treated with water, white bars indicate NSP1 and NSP2 overexpressing plants treated with CO8, right-pointing striped bars indicate a second isolate of NSP1 and NSP2 overexpressing plants treated with water, and left-pointing striped bars indicate NSP1 and NSP2 overexpressing plants treated with CO8. The y-axis indicates relative light units (RLU) of the reactive oxygen species assay. As indicated from left to right on the x-axis, plants were grown under conditions with replete nitrate and phosphate (+N+P, 5 mM $NO_3^-$ and 0.5 mM $PO_4^-$), limiting nitrate and replete phosphate (−N+P, 0 mM $NO_3^-$ and 0.5 mM $PO_4^-$), or replete nitrate and limiting phosphate (+N−P, 5 mM $NO_3^-$ and 0.0075 mM $PO_4^-$). FIG. 20I shows the effect of overexpressing both NSP1 and NSP2 transcription factors in *H. vulgare* on mycorrhizal colonization by *R. irregularis* under high phosphate conditions. The x-axis indicates the genotype of *H. vulgare* tested, with "wt" indicating wild type, NSP1 indicating plants with NSP1 overexpressed, NSP2 indicating plants with NSP2 overexpressed, and NSP1/NSP2 indicating plants with both NSP1 and NSP2 overexpressed. Plants were grown under 3 mM $NO_3$, and the x-axis also indicates the nutrient conditions tested, with HP indicating high phosphate (1 mM $PO_4^-$) and LP indicating low phosphate (10 μM $PO_4^-$). The asterisks above the brackets at the top of FIG. 20I indicate statistically significant differences in total colonization, as determined by a Mann-Whitney test. In FIG. 20I, the y-axis represents the percentage of root length colonization by mycorrhizal fungi, and the shading of each bar represents the fungal structure that was quantified. The lightest grey bars represent the total root colonization, and, from light to darkest grey, the other bars represent the hyphopodia (H), intraradical hyphae (IH), arbuscules (A), and vesicles (V).

Figure 21A:
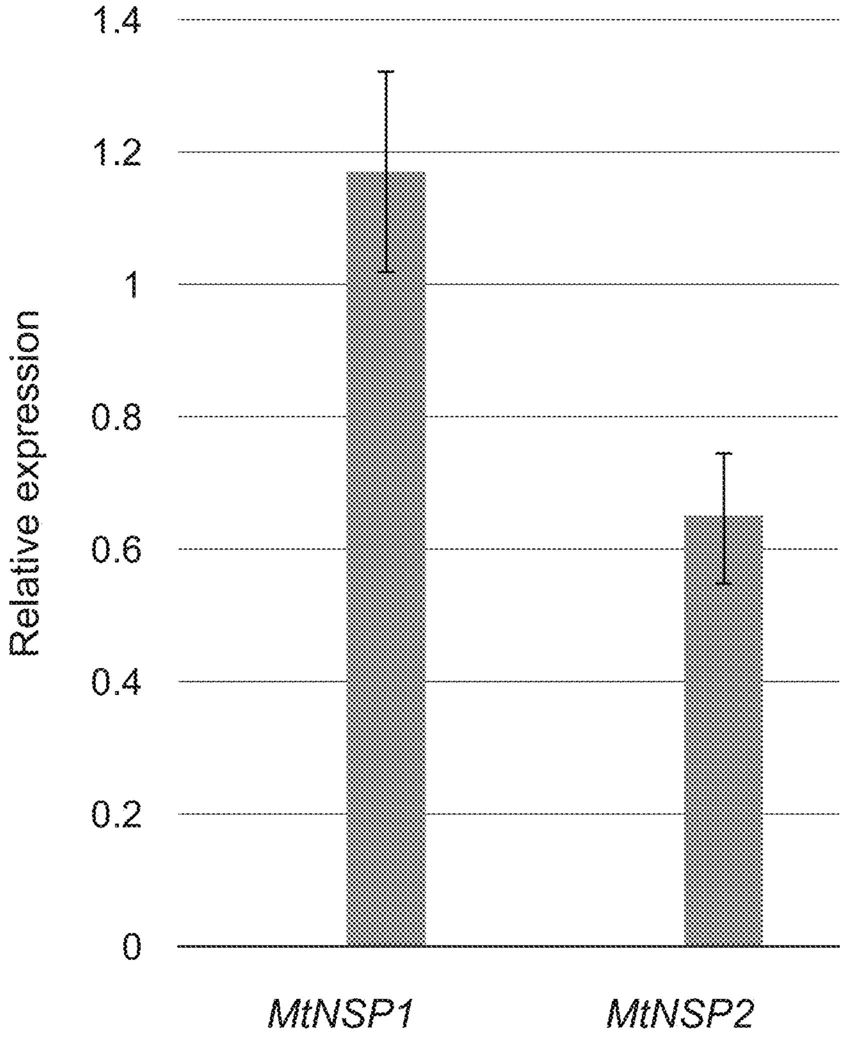
Figure 21C:
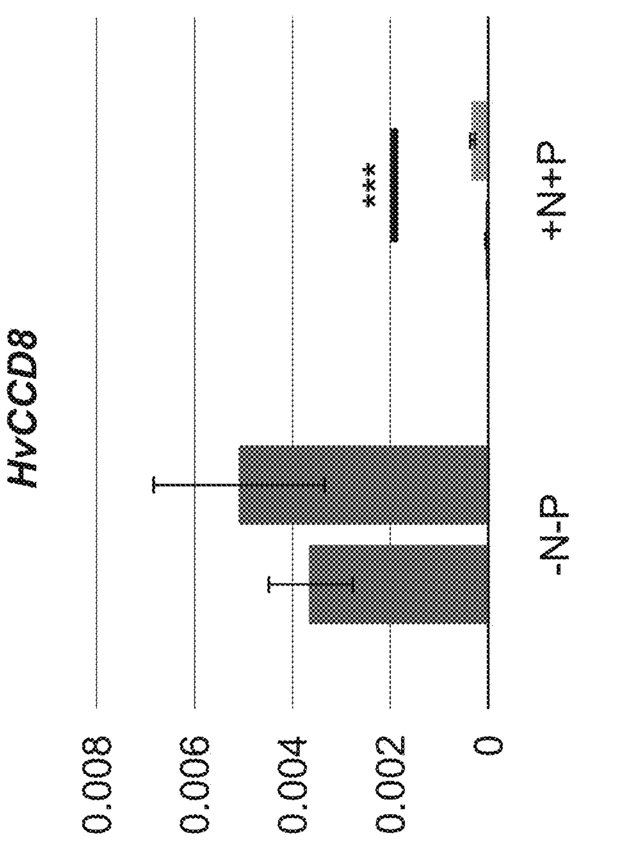
Figure 21B:
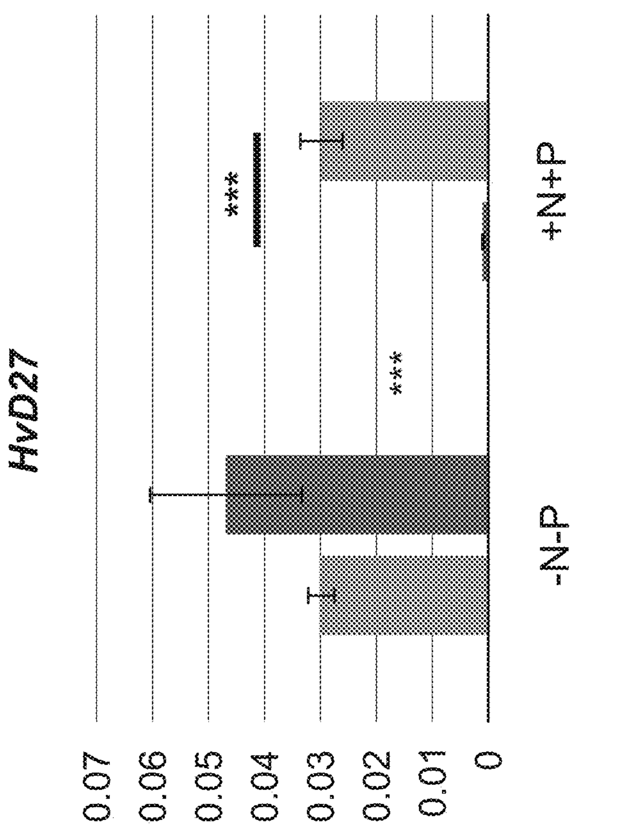
Figure 21D:
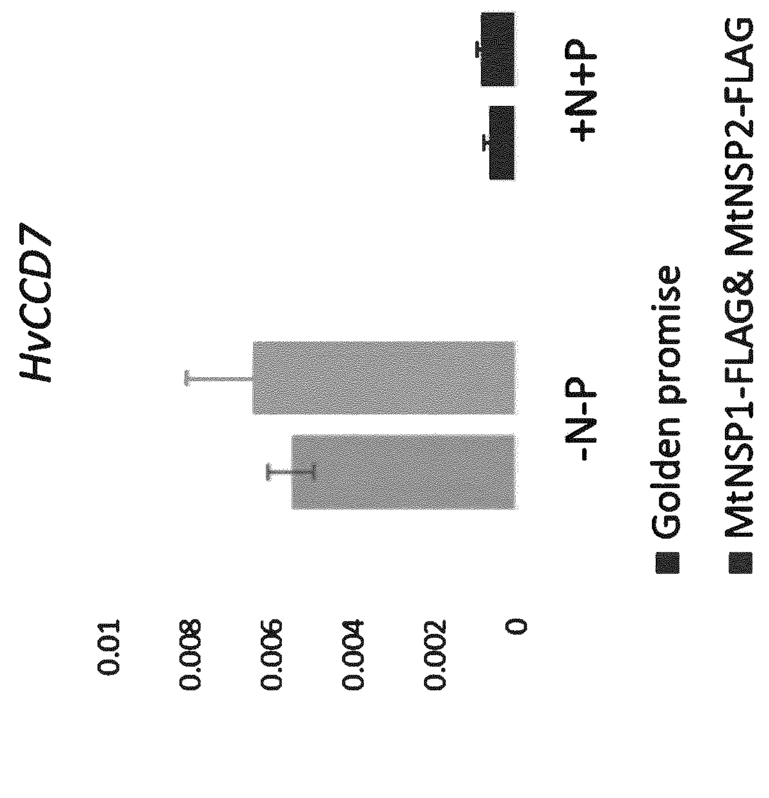
Figure 21E:
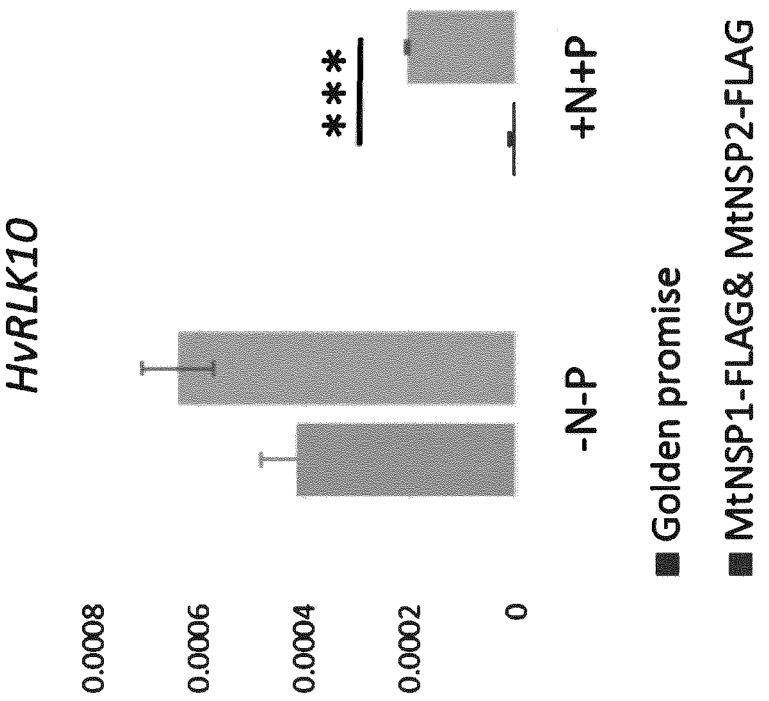

FIGS. 21A-21F show the effects of engineering NSP1 and NSP2 transcription factors in *H. vulgare* on gene expression under different nutrient conditions. FIGS. 21A-21E show the effects of overexpressing both NSP1 and NSP2 transcription factors in *H. vulgare*. FIG. 21A shows the expression of *M. truncatula* NSP1 and NSP2 in 21 day old *H. vulgare* roots grown under replete nitrate and replete phosphate conditions. FIGS. 21B-21E show the expression of 21 day old *H. vulgare* roots grown under limiting nitrate and limiting phosphate conditions (−N−P, 0 mM $NO_3^-$ and 0 mM $PO_4^-$, left side of graph), or replete nitrate and replete phosphate conditions (+N+P, 5 mM $NO_3^-$ and 0.5 mM $PO_4^-$, right side of graph). FIG. 21B shows expression of HvD27. FIG. 21C shows expression of HvCCD8 (primers for qPCR did not differentiate between HvCCD8 copy one (chr3Hg0246861) and HvCCD8 copy two (chr3Hg0309501)). FIG. 21D shows expression of HvCCD7. FIG. 21E shows expression of HvRLK10. In FIGS. 21A-21E, the y-axis shows relative gene expression levels, expression from the wild type *H. vulgare* (Golden promise) is shown on left in each group, and expression from *H. vulgare* with *M. truncatula* NSP1 and NSP2 overexpressed is shown on right in each group. Values shown are mean±SD, and * indicates P<0.001 as indicated by a Student's t-test. FIG. 21**F shows the results of RNA-seq analysis of HvCCD7 ("CCD7"), HvCCD8 copy one ("CCD8=chr3Hg0246861"), HvCCD8 copy two ("CCD8=chr3Hg0309501"), HvD27 ("D27"), and HvRLK10 ("RLK10") conducted on barley lines with mutated NSP1 ("nsp1", line nsp1-4), mutated NSP2 ("nsp2", line nsp2-2), overexpressed NSP1 ("NSP1ox", line oxNSP1-20694), overexpressed NSP2 ("NSP2ox", line oxNSP2-20639), and the wild type *H. vulgare* Golden Promise ("GP") grown under different nutrient conditions. Log 2(Fold-change) values (p≤0.05) of the genes in each line are shown relative to the WT within every nutrient condition (WT values are therefore provided as 0). The scale on the right indicates the relative expression levels, with grey representing the lowest expression and dark grey representing the highest expression, and numerical values are also provided for the expression levels. The nutrient conditions include replete nitrate and replete phosphate conditions (+N+P, 5 mM $NO_3^-$ and 0.5 mM $PO_4^-$, leftmost column), limiting nitrate and replete phosphate conditions (−N+P, 0 mM $NO_3^-$ and 0.5 mM $PO_4^-$, second from left column), replete nitrate and limiting phosphate conditions (+N−P, 5 mM $NO_3^-$ and 0 mM $PO_4^-$, second from right column), and limiting nitrate and limiting phosphate conditions (−N−P, 0 mM $NO_3^-$ and 0 mM $PO_4^-$, rightmost column). All plants were grown in sand for 21 days before being harvested for analysis.

Figure 22A:
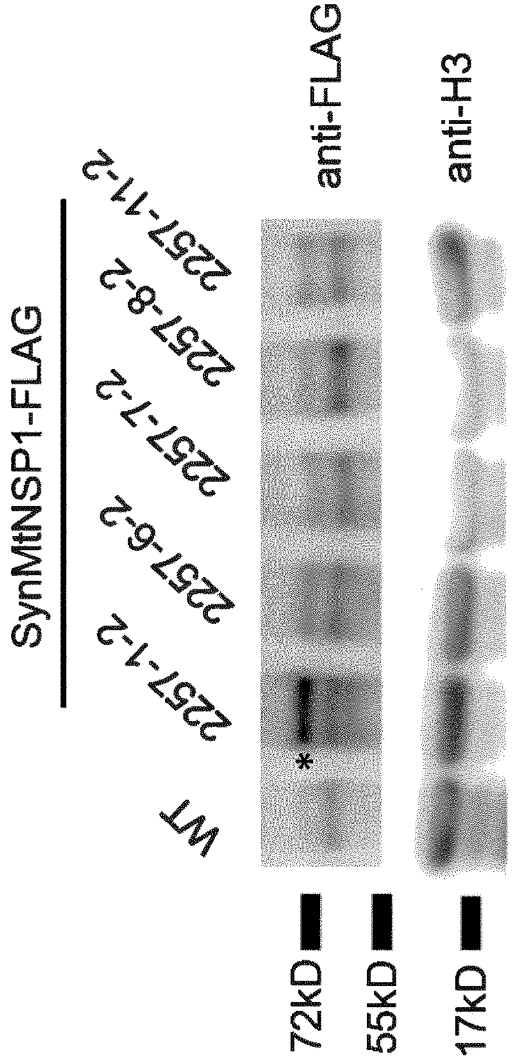
Figure 22B:
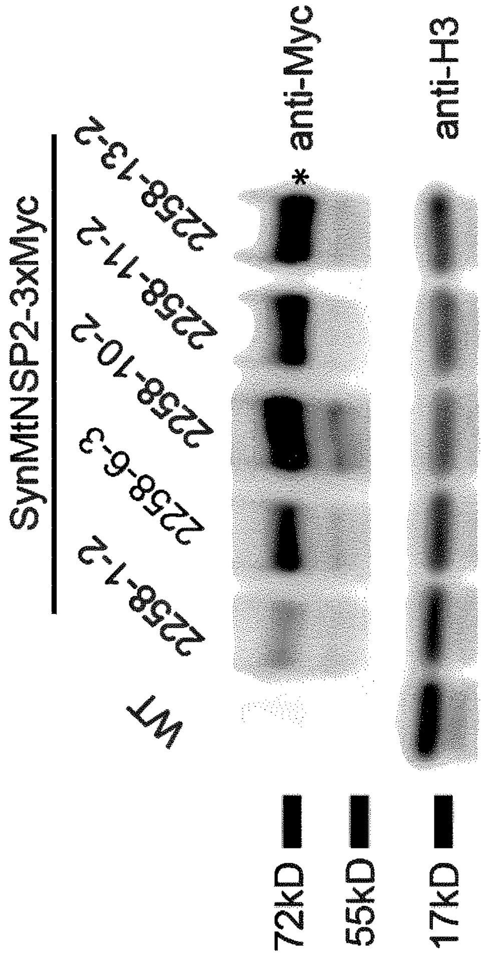
Figure 22C:
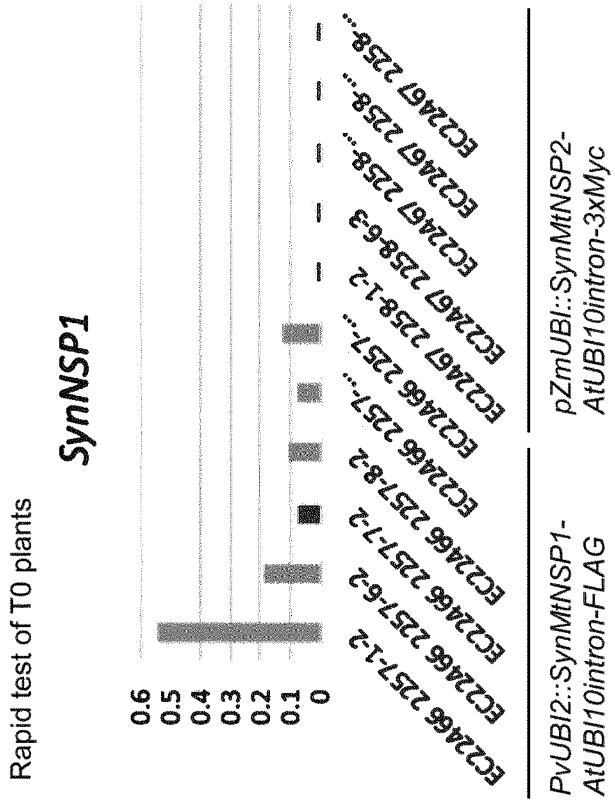
Figure 22D:
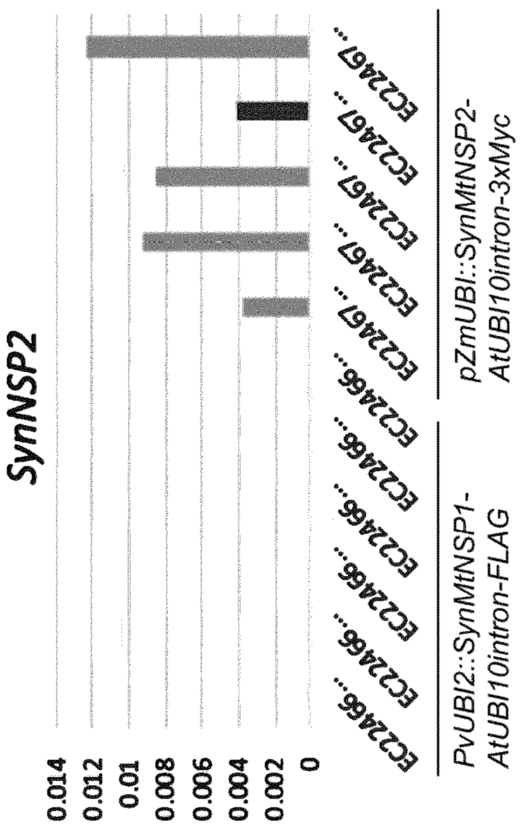
Figure 22E:
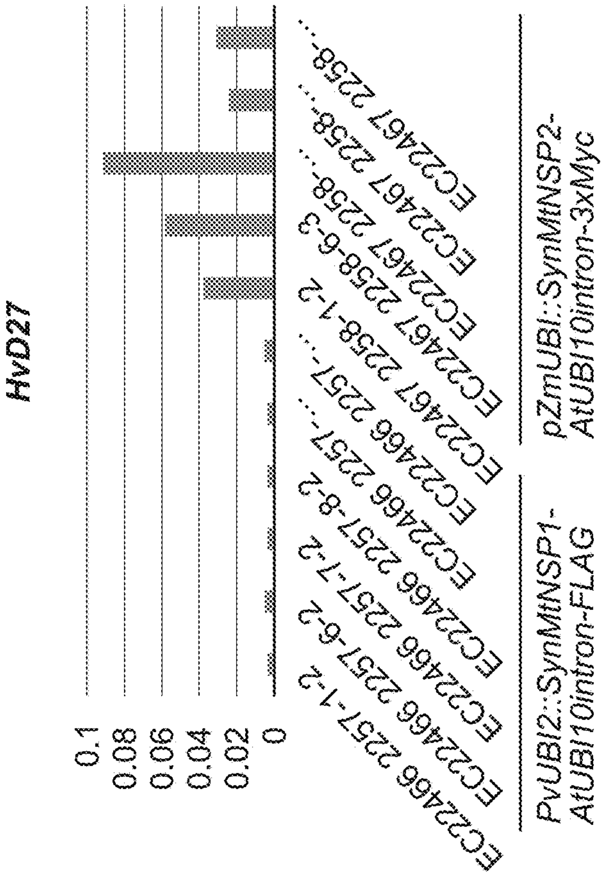
Figure 22F:
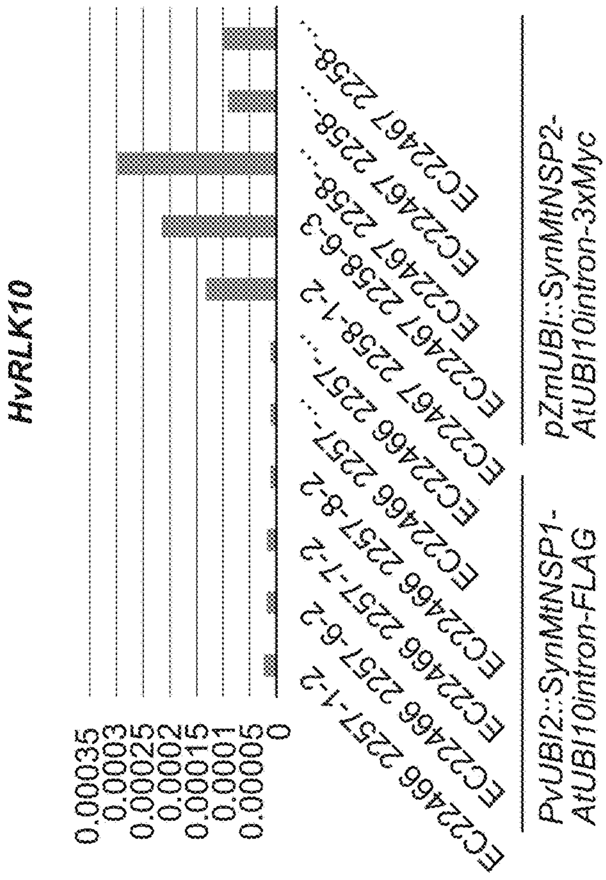

FIGS. 22A-22F provide data related to the overexpression of codon-optimized NSPs in *H. vulgare*. FIGS. 22A-22B provide Western blots showing the detection of tagged codon-optimized *M. truncatula* NSP1 and/or NSP2 overexpressed in *H. vulgare*. FIG. 22A shows anti-FLAG blots of five isolates of *H. vulgare* transformed with codon-optimized *M. truncatula* NSP1-FLAG (SynMtNSP1-FLAG) compared to WT (control). The asterisk indicates NSP1-FLAG. FIG. 22B shows anti-Myc blots of five isolates of *H. vulgare* transformed with codon-optimized *M. truncatula* NSP2-3×Myc (SynMtNSP2-3×Myc) compared to WT (control). The asterisk indicates NSP2-Myc. In both FIG. 22A and FIG. 22B, *H. vulgare* plants were grown in nitrate and phosphate replete conditions (+N+P, 5 mM $NO_3^-$ and 0.5 mM $PO_4^-$), samples were collected 21 days after germination, and an anti-histone $H_3$ blot is shown below as a loading control. FIGS. 22C-22F show the effect of overexpressing codon-optimized NSP1 or NSP2 transcription factors in *H. vulgare* on gene expression, as measured by RT-qPCR. In each of FIGS. 22C-22F, *H. vulgare* isolates transformed with the codon-optimized NSP1 expression construct PvUBI2::SynMtNSP1-AtUBI10intron-FLAG are shown on the left of the x-axis, and isolates transformed with the codon-optimized NSP2 expression construct pZmUBI::SynMtNSP2-AtUBI10intron-3×Myc are shown on the right of the x-axis. FIG. 22C shows expression of codon-optimized NSP1 (Syn NSP1). FIG. 22D shows expression of codon-optimized NSP2 (SynNSP2). FIG. 22E shows expression of HvD27. FIG. 22F shows expression of HvRLK10. In each of FIGS. 22C-22F, *H. vulgare* plants were grown in nitrate and phosphate replete conditions (+N+P, 5 mM $NO_3^-$ and 0.5 mM $PO_4^-$), and samples were collected 21 days after germination.

Figure 23:
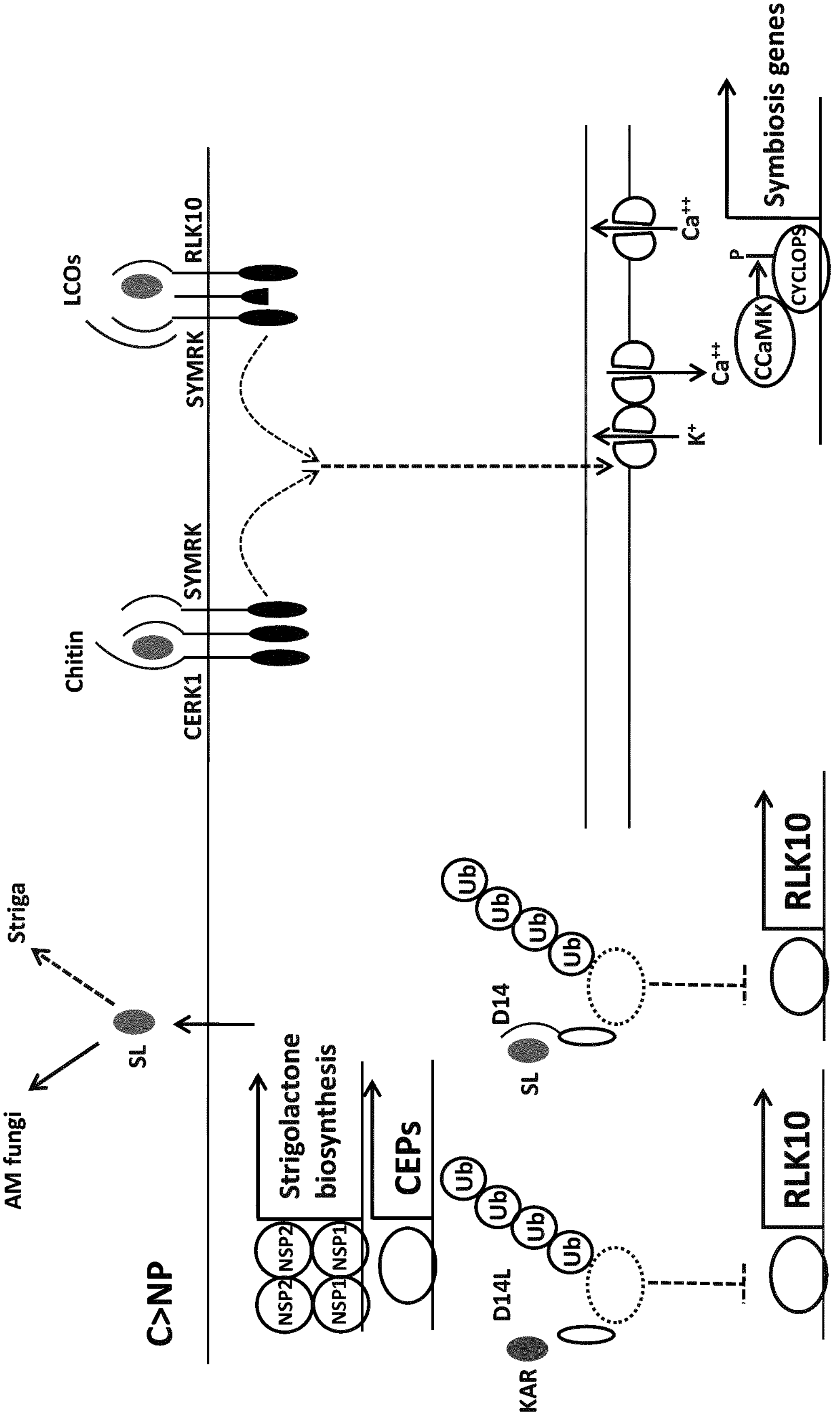

FIG. 23 provides a schematic diagram showing a model for the regulation of LCO receptors and symbiosis signaling during nutrient starvation in barley. Under low nutrient conditions (C>NP) expression of NSP1 and NSP2 is induced, which in turn promotes the expression of strigolactone (grey ovals labelled "SL") biosynthesis genes. The resultant strigolactones act as a signal in the rhizosphere to promote mycorrhizal fungal development, and also act as a native plant signal that leads to the expression of RLK10, which is the closest barley homolog of the LCO (grey oval labelled "LCO") receptor. LCOs are signaling molecules produced by arbuscular mycorrhizal fungi. Chitin (grey oval labelled "Chitin") is a component of fungal cell walls, which under nutrient starvation is primarily associated with promoting symbiosis signaling.

Figure 24A:
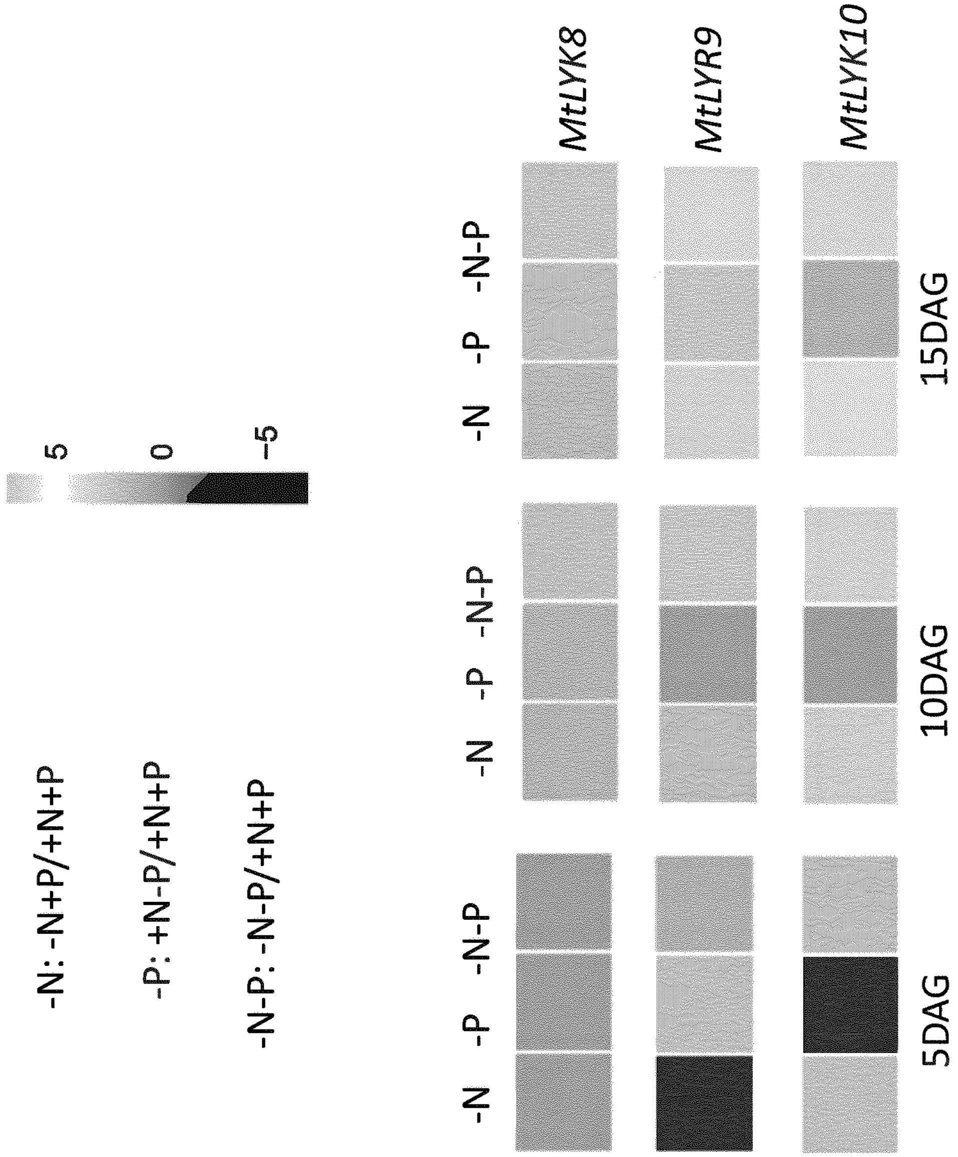
Figure 24B:
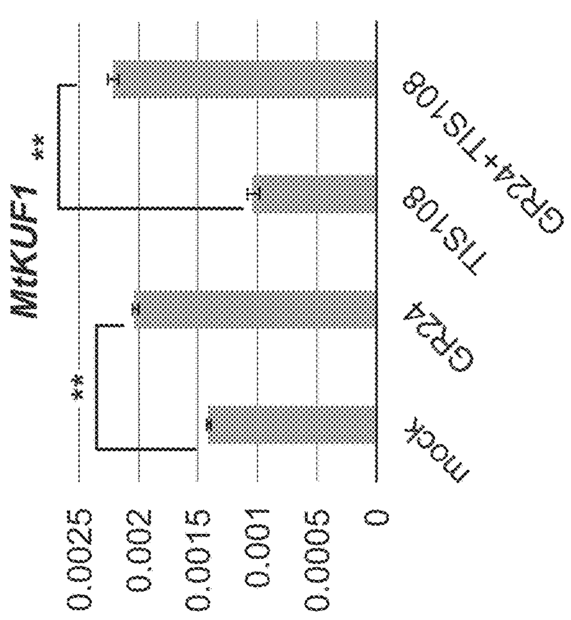
Figure 24C:
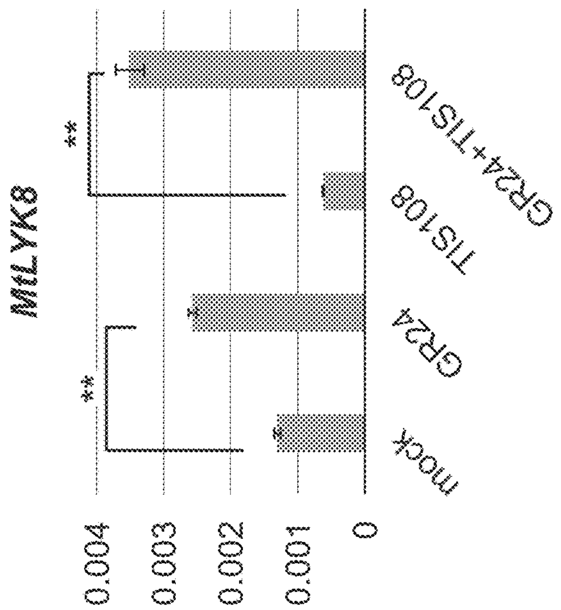
Figure 24D:
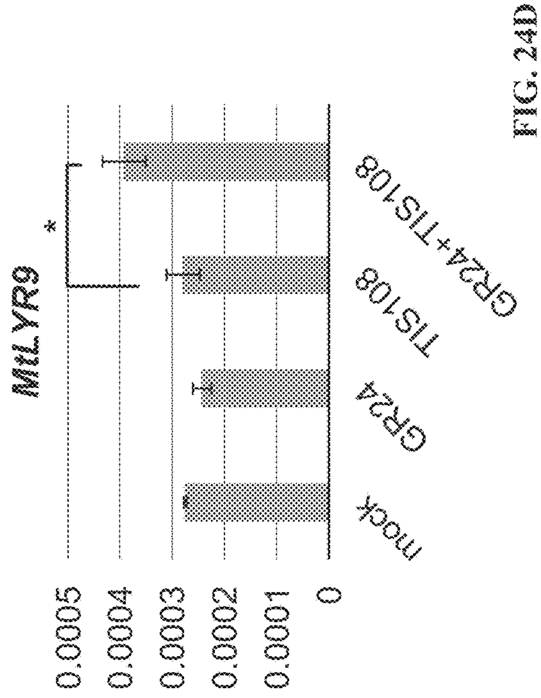
Figure 24E:
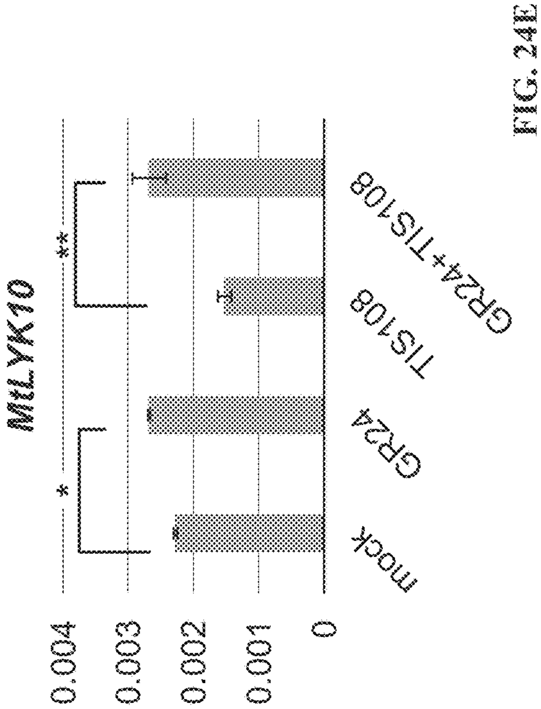

FIGS. 24A-24E show the effects of nutrient starvation and strigolactone and/or karrikin treatment on *M. truncatula* RLK gene expression levels. FIG. 24A shows a heatmap showing the expression levels of *M. truncatula* genes MtLYK8, MtLYR9, and MtLYK10 under different nutrient conditions, as determined by RNA-seq. As indicated from left to right above the heat map, *M. truncatula* was grown under limiting nitrate (−N, 0 mM $NO_3^-$ and 3.75 mM $PO_4^-$), limiting phosphate (−P, 5 mM $NO_3^-$ and 0.0075 mM $PO_4^-$), or limiting nitrate and phosphate (−N−P, 0 mM $NO_3^-$ and 0.0075 mM $PO_4^-$). The relative expression level of each condition is normalized to expression when plants were grown under replete nitrate and replete phosphate (+N+P, 5 mM $NO_3^-$ and 3.75 mM $PO_4^-$). As indicated from left to right below the heatmap, expression was measured either 5, 10, or 15 days after germination ("DAG"). The color scale indicates the relative expression levels, with black representing the lowest expression and light grey representing the highest expression. FIGS. 24B-24E show expression of *M. truncatula* genes after seedlings were grown on BNM plates for 4 days, and then treated with either DMSO (mock), 0.1 μM synthetic strigolactone analog GR24, 1 μM strigolactone-biosynthesis inhibitor TIS108, or both (0.1 μM GR24 and 1 μM TIS108) for 24 hours, as indicated on the x-axis. FIG. 24B shows expression levels of MtKUF1, FIG. 24C shows expression levels of MtLYK8, FIG. 24D shows expression of MtLYR9, and FIG. 24E shows expression levels of MtLYK10. In each of FIGS. 24B-24E gene expression was determined by RT-qPCR, relative expression levels is on the y-axis, and the asterisks indicate the relative level of statistical significance as determined by a Student's t-test.

Figure 25A:
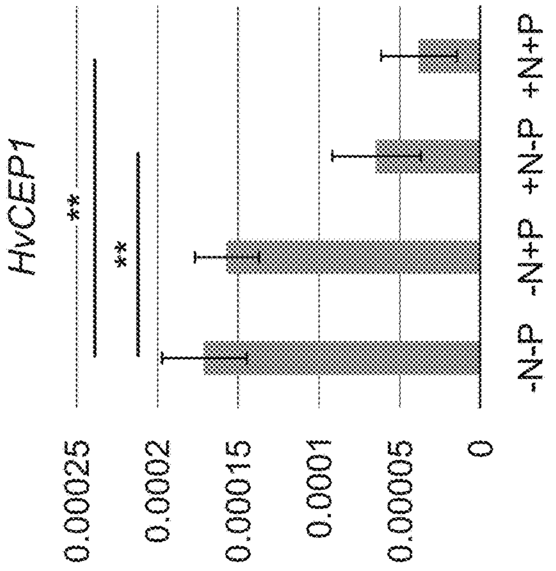
Figure 25B:
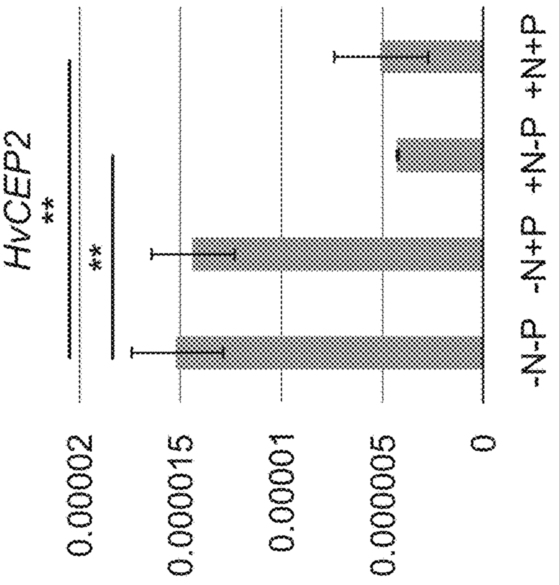
Figure 25C:
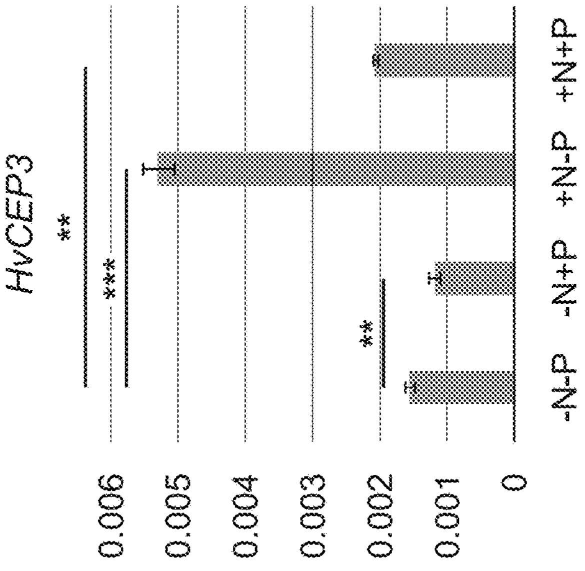
Figure 25D:
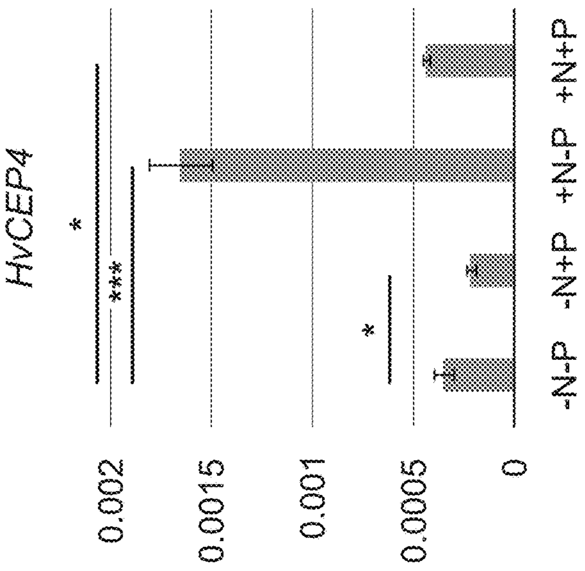

FIGS. 25A-25D show the expression levels of *H. vulgare* CEP peptide genes under different nutrient conditions. In each of FIGS. 25A-25D, wild type *H. vulgare* was grown on plates containing either replete nitrate and replete phosphate (+N+P, 5 mM $NO_3^-$ and 0.5 mM $PO_4^-$), replete nitrate and limiting phosphate (+N−P, 5 mM $NO_3^-$ and 0 mM $PO_4^-$), limiting nitrate and replete phosphate (−N+P, 0 mM $NO_3^-$ and 0.5 mM $PO_4^-$), or limiting nitrate and limiting phosphate (−N−P, 0 mM $NO_3^-$ and 0 mM $PO_4^-$), as indicated on the x-axes, for 10 days. FIG. 25A shows expression levels of HvCEP1, FIG. 25B shows expression levels of HvCEP2, FIG. 25C shows expression levels of HvCEP3, and FIG. 25D shows expression levels of HvCEP4. The y-axes show relative expression levels as determined by RT-qPCR. Values shown are mean±SD (n=3), and * indicates P<0.001,  indicates P<0.01, and * indicates 0.01<P<0.05, as determined by a Student's t-test.

FIGS. 26A-26L show the alignment of NSP1 polypeptide sequences from *Medicago truncatula* (MtNSP1_Medtr8g020840.1, SEQ ID NO: 177), *Glycine max* (Glymax_Glyma.07G039400.1, SEQ ID NO: 83; Glymax_Glyma.16G008200.1, SEQ ID NO: 84), *Hordeum vulgare* (Horvul_HORVU2Hr1G104160.1, SEQ ID NO: 100; Horvul_HORVU2Hr1G104170.1, SEQ ID NO: 101; Horvul_HORVU7Hr1G060780.1, SEQ ID NO: 102; Horvul_HORVU7Hr1G115720.3, SEQ ID NO: 103; Horvul_HORVU5Hr1G097760.3, SEQ ID NO: 104; Horvul_HORVU2Hr1G040860.5, SEQ ID NO: 105; Horvul_HORVU5Hr1G117780.1, SEQ ID NO: 106), *Manihot esculenta* (Manesc_Manes.11G019900.1, SEQ ID NO: 118; Manesc_Manes.04G145200.1, SEQ ID NO: 119), *Oryza sativa* (LOC_Os05g42130.1, SEQ ID NO: 179; Orysat_LOC_Os03g29480.1, SEQ ID NO: 94), *Solanum tuberosum* (PGSC0003DMP400061367(nsp1), SEQ ID NO: 176), *Triticum aestivum* (Traes_2BL_88A78A71E.1(nsp1), SEQ ID NO: 174), *Vigna unguiculata* (Vigung_Vigun10g164000.1, SEQ ID NO: 86), and *Zea mays* (Zeamay_Zm00008a029343, SEQ ID NO: 93; Zeamay_Zm00008a001715, SEQ ID NO: 96; Zeamay_Zm00008a035164, SEQ ID NO: 98). FIG. 26A shows the alignment of the N terminal portion of the NSP1 polypeptide. FIG. 26B shows the alignment of the first part of the central portion of the NSP1 polypeptide. FIG. 26C shows the alignment of the second part of the central portion of the NSP1 polypeptide. FIG. 26D shows the alignment of the third part of the central portion of the NSP1 polypeptide.

FIG. 26E shows the alignment of the fourth part of the central portion of the NSP1 polypeptide. FIG. 26F shows the alignment of the fifth part of the central portion of the NSP1 polypeptide. FIG. 26G shows the alignment of the sixth part of the central portion of the NSP1 polypeptide. FIG. 26H shows the alignment of the seventh part of the central portion of the NSP1 polypeptide. FIG. 26I shows the alignment of the eighth part of the central portion of the NSP1 polypeptide. FIG. 26J shows the alignment of the ninth part of the central portion of the NSP1 polypeptide. FIG. 26K shows the alignment of the tenth part of the central portion of the NSP1 polypeptide. FIG. 26L shows the alignment of the C terminal portion of the NSP1 polypeptide.

FIGS. 27A-27N show the alignment of NSP2 polypeptide sequences from *Medicago truncatula* (MtNSP2_Medtr3g072710.1, SEQ ID NO: 186), *Glycine max* (Glymax_Glyma.13G081700.1, SEQ ID NO: 130; Glymax_Glyma.04G251900.1, SEQ ID NO: 144; Glymax_Glyma.06G110800.1, SEQ ID NO: 145), *Hordeum vulgare* (HORVU4Hr1G020490.28, SEQ ID NO: 184; Horvul_HORVU4Hr1G061310.1, SEQ ID NO: 156), *Manihot esculenta* (Manesc_Manes.18G075300.1, SEQ ID NO: 165; Manesc_Manes.02G161100.1, SEQ ID NO: 166), *Oryza sativa* (LOC_Os12g06540.1, SEQ ID NO: 182; LOC_Os11g06180.1, SEQ ID NO: 183; Orysat_LOC_Os03g15680.1, SEQ ID NO: 153), *Solanum tuberosum* (PGSC0003DMP400021345(nsp2), SEQ ID NO: 75), *Triticum aestivum* (Traes_4AS_19FA06316.1(nsp2), SEQ ID NO: 175), *Vigna unguiculata* (Vigung_Vigun08g091300.1, SEQ ID NO: 132; Vigung_Vigun09g168400.1, SEQ ID NO: 147; Vigung_Vigun09g168500.1, SEQ ID NO: 148), and *Zea mays* (Zeamay_Zm00008a001015, SEQ ID NO: 159). FIG. 27A shows the alignment of the N terminal portion of the NSP2 polypeptide. FIG. 27B shows the alignment of the first part of the central portion of the NSP2 polypeptide. FIG. 27C shows the alignment of the second part of the central portion of the NSP2 polypeptide. FIG. 27D shows the alignment of the third part of the central portion of the NSP2 polypeptide. FIG. 27E shows the alignment of the fourth part of the central portion of the NSP2 polypeptide. FIG. 27F shows the alignment of the fifth part of the central portion of the NSP2 polypeptide. FIG. 27G shows the alignment of the sixth part of the central portion of the NSP2 polypeptide. FIG. 27H shows the alignment of the seventh part of the central portion of the NSP2 polypeptide. FIG. 27I shows the alignment of the eighth part of the central portion of the NSP2 polypeptide. FIG. 27J shows the alignment of the ninth part of the central portion of the NSP2 polypeptide. FIG. 27K shows the alignment of the tenth part of the central portion of the NSP2 polypeptide. FIG. 27L shows the alignment of the eleventh part of the central portion of the NSP2 polypeptide. FIG. 27M shows the alignment of the twelfth part of the central portion of the NSP2 polypeptide. FIG. 27N shows the alignment of the C terminal portion of the NSP2 polypeptide.

FIGS. 28A-28D show the alignment of CEP protein sequences from *Hordeum vulgare, Oryza sativa, Zea mays, Triticum aestivum*, and *Manihot esculenta*. FIG. 28A shows the alignment of the CEP1 proteins from *Hordeum vulgare* ("HvCEP1", SEQ ID NO: 209), *Oryza sativa* ("LOC_Os09g28780.1", SEQ ID NO: 210 and "LOC_Os08g37070.1", SEQ ID NO: 211), *Zea mays* ("Zm00001e003812_POO1", SEQ ID NO: 212), and *Manihot esculenta* ("Manes.12G100300.1", SEQ ID NO: 213), as well as the consensus sequences SEQ ID NO: 214 ("consensus/100%"), SEQ ID NO: 215 ("consensus/90%"), SEQ ID NO: 216 ("consensus/80%"), and SEQ ID NO: 217 ("consensus/70%"). FIG. 28B shows the alignment of the CEP2 proteins from *Hordeum vulgare* ("HvCEP2", SEQ ID NO: 218), *Oryza sativa* ("LOC_Os09g28780.1", SEQ ID NO: 219), and *Zea mays* ("Zm00001e003812_POO1", SEQ ID NO: 220), as well as the consensus sequences SEQ ID NO: 221 ("consensus/100%"), SEQ ID NO: 222 ("consensus/90%"), SEQ ID NO: 223 ("consensus/80%"), and SEQ ID NO: 224 ("consensus/70%"). FIG. 28C shows the alignment of the CEP3 proteins from *Hordeum vulgare* ("HvCEP3", SEQ ID NO: 225), *Triticum aestivum* ("Traes_7BL_D35EA83DB.1", SEQ ID NO: 226; "Traes 7AL_0C3298060.1", SEQ ID NO: 227; and "Traes 7DL_5D1114AED4.1", SEQ ID NO: 228), and *Zea mays* ("Zm00001e030196_POO1", SEQ ID NO: 229), as well as the consensus sequences SEQ ID NO: 230 ("consensus/100%"), SEQ ID NO: 231 ("consensus/90%"), SEQ ID NO: 232 ("consensus/80%"), and SEQ ID NO: 233 ("consensus/70%"). FIG. 28D shows the alignment of the CEP4 proteins from *Hordeum vulgare* ("HvCEP4", SEQ ID NO: 234), *Triticum aestivum* ("Traes_3B_148834D30.1", SEQ ID NO: 235), *Oryza sativa* ("LOC_Os08g37070.1", SEQ ID NO: 236), and *Zea mays* ("Zm00001e003812_P001", SEQ ID NO: 237), as well as the consensus sequences SEQ ID NO: 238 ("consensus/100%"), SEQ ID NO: 239 ("consensus/90%"), SEQ ID NO: 240 ("consensus/80%"), and SEQ ID NO: 241 ("consensus/70%").

DETAILED DESCRIPTION

The following description sets forth exemplary methods, parameters, and the like. It should be recognized, however, that such description is not intended as a limitation on the scope of the present disclosure but is instead provided as a description of exemplary embodiments.

Methods of Cultivating Genetically Altered Plants

An aspect of the disclosure includes methods of cultivating a genetically altered plant with increased mycorrhization and/or promoted symbiotic responses under conditions including a phosphate level around the plant roots that suppresses mycorrhization and/or symbiotic responses, including: (a) providing the genetically altered plant, wherein the plant or a part thereof includes one or more genetic alterations, wherein the one or more genetic alterations reduce the phosphate level suppression of mycorrhization and/or symbiotic responses; and (b) cultivating the genetically altered plant under the phosphate level around the plant roots, wherein the genetically altered plant has increased mycorrhization and/or promoted symbiotic responses as compared to a wild type (WT) plant grown under the same conditions. An additional embodiment of this aspect includes the one or more genetic alterations resulting in increased activity of one or more of a NODULATION SIGNALING PATHWAY 1 (NSP1) protein or a NODULATION SIGNALING PATHWAY 2 (NSP2) protein. Yet another embodiment of this aspect includes the increased activity being at least 10% greater, at least 15% greater, at least 20% greater, at least 25% greater, at least 30% greater, at least 35% greater, at least 40% greater, at least 45% greater, at least 50% greater, at least 55% greater, at least 60% greater, at least 65% greater, at least 70% greater, at least 75% greater, at least 80% greater, at least 85% greater, at least 90% greater, at least 95% greater, at least 100% greater, at least 110% greater, at least 120% greater, at least 130% greater, at least 140% greater, at least 150% greater, at least 160% greater, at least 170% greater, at least 180% greater, at least 190% greater, or at least 200% greater than the activity of the corresponding one or more proteins in the WT plant grown under the same conditions. A further embodiment of this aspect, which may be combined with any of the preceding embodiments that has the one or more genetic alterations resulting in increased activity, includes the increased activity being no greater than 500%, no greater than 475%, no greater than 450%, no greater than 425%, no greater than 400%, no greater than 375%, no greater than 350%, no greater than 325%, no greater than 300%, no greater than 275%, no greater than 250%, no greater than 225%, no greater than 200%, no greater than 175%, no greater than 150%, or no greater than 125% of the activity of the corresponding one or more proteins in the WT plant grown under the same conditions. Still another embodiment of this aspect, which may be combined with any of the preceding embodiments that has the one or more genetic alterations resulting in increased activity, includes the NSP1 protein including an amino acid sequence with at least 70% sequence identity to, at least 71% sequence identity to, at least 72% sequence identity to, at least 73% sequence identity to, at least 74% sequence identity to, at least 75% sequence identity to, at least 76% sequence identity to, at least 77% sequence identity to, at least 78% sequence identity to, at least 79% sequence identity to, at least 80% sequence identity to, at least 81% sequence identity to, at least 82% sequence identity to, at least 83% sequence identity to, at least 84% sequence identity to, at least 85% sequence identity to, at least 86% sequence identity to, at least 87% sequence identity to, at least 88% sequence identity to, at least 89% sequence identity to, at least 90% sequence identity to, at least 91% sequence identity to, at least 92% sequence identity to, at least 93% sequence identity to, at least 94% sequence identity to, at least 95% sequence identity to, at least 96% sequence identity to, at least 97% sequence identity to, at least 98% sequence identity to, or at least 99% sequence identity to SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207. In an additional embodiment of this aspect, the NSP1 protein includes SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207. A gene tree of NSP1 homologs is shown in FIG. 17C. An alignment of NSP1 proteins is shown in FIGS. 26A-26L. Yet another embodiment of this aspect, which may be combined with any of the preceding embodiments that has the one or more genetic alterations resulting in increased activity, includes the NSP2 protein including an amino acid sequence with at least 70% sequence identity to, at least 71% sequence identity to, at least 72% sequence identity to, at least 73% sequence identity to, at least 74% sequence identity to, at least 75% sequence identity to, at least 76% sequence identity to, at least 77% sequence identity to, at least 78% sequence identity to, at least 79% sequence identity to, at least 80% sequence identity to, at least 81% sequence identity to, at least 82% sequence identity to, at least 83% sequence identity to, at least 84% sequence identity to, at least 85% sequence identity to, at least 86% sequence identity to, at least 87% sequence identity to, at least 88% sequence identity to, at least 89% sequence identity to, at least 90% sequence identity to, at least 91% sequence identity to, at least 92% sequence identity to, at least 93% sequence identity to, at least 94% sequence identity to, at least 95% sequence identity to, at least 96% sequence identity to, at least 97% sequence identity to, at least 98% sequence identity to, or at least 99% sequence identity to SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208. In a further embodiment of this aspect, the NSP2 protein includes SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208. A gene tree of NSP2 homologs is shown in FIG. 17D. An alignment of NSP2 proteins is shown in FIGS. 27A-27N.

Yet another embodiment of this aspect, which may be combined with any of the preceding embodiments that has the one or more genetic alterations resulting in increased activity, includes one or more of the NSP1 protein and the NSP2 protein being endogenous. A further embodiment of this aspect includes increased activity of the one or more endogenous NSP1 protein and the endogenous NSP2 protein being achieved using a gene editing technique to introduce the one or more genetic alterations. Still another embodiment of this aspect includes the gene editing technique being selected from the group of transcription activator-like effector nuclease (TALEN) gene editing techniques, clustered Regularly Interspaced Short Palindromic Repeat (CRISPR/Cas) gene editing techniques, or zinc-finger nuclease (ZFN) gene editing techniques. In an additional embodiment of this aspect, which may be combined with any of the preceding embodiments that has a gene editing technique to introduce the one or more genetic alterations, the one or more genetic alterations that increase the activity of the endogenous protein are selected from the group of inactivating a repressor element that represses expression of the endogenous protein, removing a repressor element that represses expression of the endogenous protein, modulating the methylation state of a repressor element that represses expression of the endogenous protein, activating an enhancer element that increases expression of the endogenous protein, adding an enhancer element that increases expression of the endogenous protein, modulating the methylation state of an enhancer element that increases expression of the endogenous protein, adding a transcriptional activator recruiting or binding element that activates expression of the endogenous protein, replacing the endogenous promoter with an overexpression promoter that directs expression of the endogenous protein, modulating the methylation state of the endogenous promoter, modulating the methylation state of the endogenous coding sequence, adding elements that stabilize an endogenous mRNA encoding the endogenous protein, removing elements that destabilize the endogenous mRNA encoding the endogenous protein, modifying a coding sequence to increase stability of the endogenous protein, or modifying a coding sequence for the endogenous protein to increase activity of the endogenous protein.

Still another embodiment of this aspect, which may be combined with any of the preceding embodiments that has the one or more genetic alterations resulting in increased activity, includes the increased activity being due to heterologous expression of one or more of the NSP1 protein and the NSP2 protein. A further embodiment of this aspect includes increased activity of the one or more of the heterologous NSP1 protein and the heterologous NSP2 protein being achieved using a vector including a first nucleic acid encoding the heterologous protein operably linked to a second nucleic acid encoding a promoter. An additional embodiment of this aspect includes the promoter being selected from the group of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, or any combination thereof.

In yet another embodiment of this aspect, which may be combined with any of the preceding embodiments, the phosphate level around the plant roots completely suppresses mycorrhization and/or symbiotic responses in the WT plant grown under the same conditions. In a further embodiment of this aspect, which may be combined with any of the preceding embodiments, the phosphate level around the plant roots inhibits mycorrhization and/or symbiotic responses in the WT plant grown under the same conditions. In still another embodiment of this aspect, which may be combined with any of the preceding embodiments, the nitrogen level around the plant roots is permissive of mycorrhization and/or symbiotic responses in the WT plant grown under the same conditions. Bioavailable nitrogen may be present in soil in the form of nitrate, ammonium, or amino acids. In an additional embodiment of this aspect, the nitrogen around the plant roots is present in the form of nitrate, and wherein the nitrate level around the plant roots is less than 2.5 mM, less than 2.4 mM, less than 2.3 mM, less than 2.2 mM, less than 2.1 mM, less than 2.0 mM, less than 1.9 mM, less than 1.8 mM, less than 1.7 mM, less than 1.6 mM, less than 1.5 mM, less than 1.4 mM, less than 1.3 mM, less than 1.2 mM, less than 1.1 mM, less than 1.0 mM, less than 0.95 mM, less than 0.9 mM, less than 0.85 mM, less than 0.8 mM, less than 0.75 mM, less than 0.7 mM, less than 0.65 mM, less than 0.6 mM, less than 0.55 mM, less than 0.5 mM, less than 0.45 mM, less than 0.4 mM, less than 0.35 mM, less than 0.3 mM, less than 0.25 mM, less than 0.2 mM, less than 0.15 mM, less than 0.1 mM, or less than 0.05 mM. In yet another embodiment of this aspect, the nitrate level around the plant roots is about 0 mM. In a further embodiment of this aspect, which may be combined with any of the preceding embodiments, the phosphate level around the plant roots includes at least 100 μM phosphate, at least 125 μM phosphate, at least 150 μM phosphate, at least 175 μM phosphate, at least 200 μM phosphate, at least 225 μM phosphate, at least 250 μM phosphate, at least 275 μM phosphate, at least 300 μM phosphate, at least 325 μM phosphate, at least 350 μM phosphate, at least 375 μM phosphate, at least 400 μM phosphate, at least 425 μM phosphate, at least 450 μM phosphate, at least 475 μM phosphate, at least 500 μM phosphate, at least 525 μM phosphate, at least 550 μM phosphate, at least 575 μM phosphate, at least 600 μM phosphate, at least 625 μM phosphate, at least 650 μM phosphate, at least 675 μM phosphate, at least 700 μM phosphate, at least 725 μM phosphate, at least 750 μM phosphate, at least 800 μM phosphate, at least 850 μM phosphate, at least 900 μM phosphate, at least 950 μM phosphate, at least 1000 μM phosphate, at least 1250 μM phosphate, at least 1500 μM phosphate, at least 1750 μM phosphate, at least 2000 μM phosphate, at least 2250 μM phosphate, at least 2500 μM phosphate, at least 2750 μM phosphate, at least 3000 μM phosphate, at least 3250 μM phosphate, at least 3500 μM phosphate, at least 3750 μM phosphate, at least 4000 μM phosphate, at least 4250 μM phosphate, at least 4500 μM phosphate, at least 4750 μM phosphate, or at least 5000 μM phosphate.

Figure 10A:
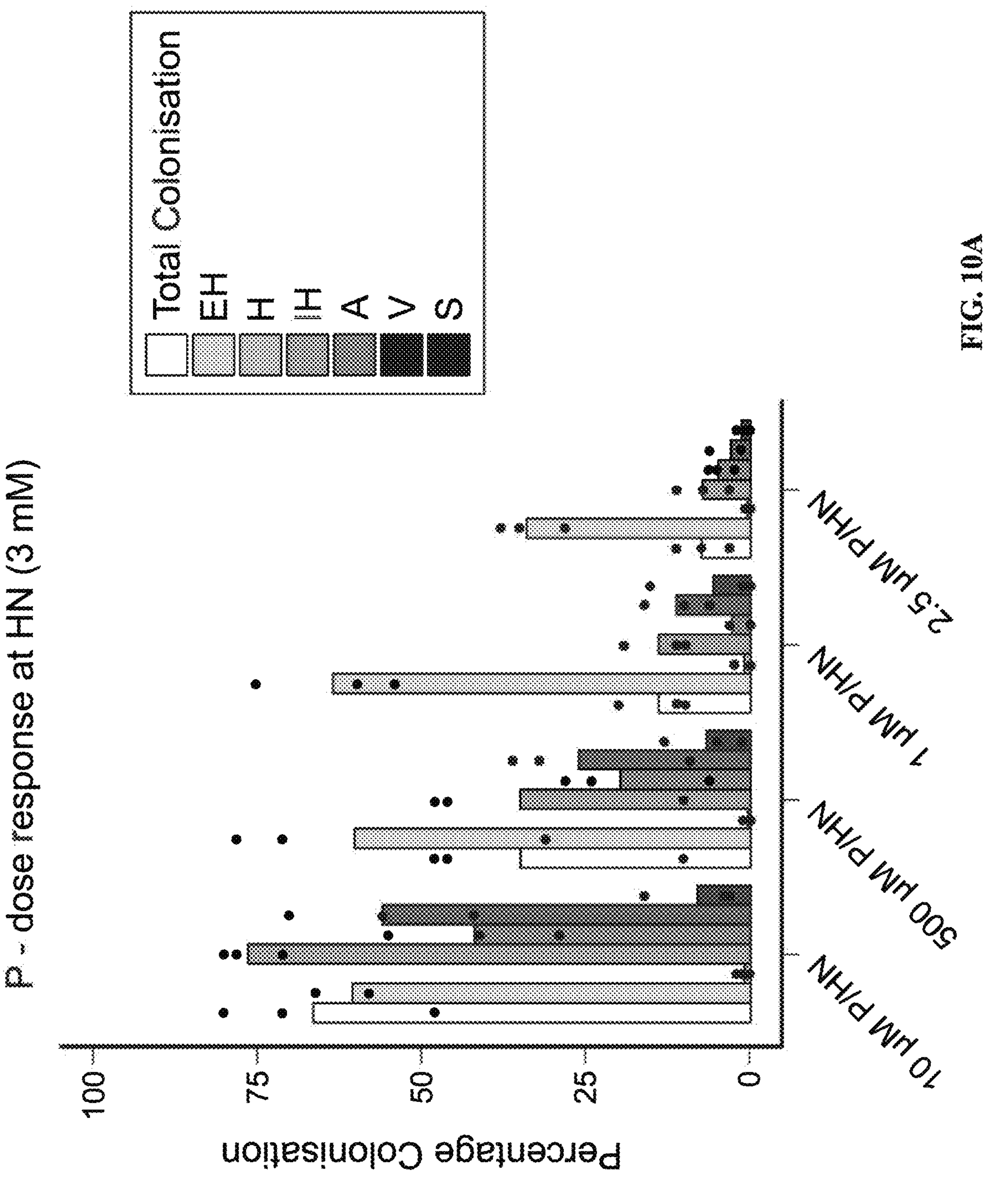
FIGS. 10A-10C provide the level of mycorrhizal colonization (i.e., colonization with *R. irregularis*) of *H. vulgare* plants grown under different nutrient conditions.
Figure 10B:
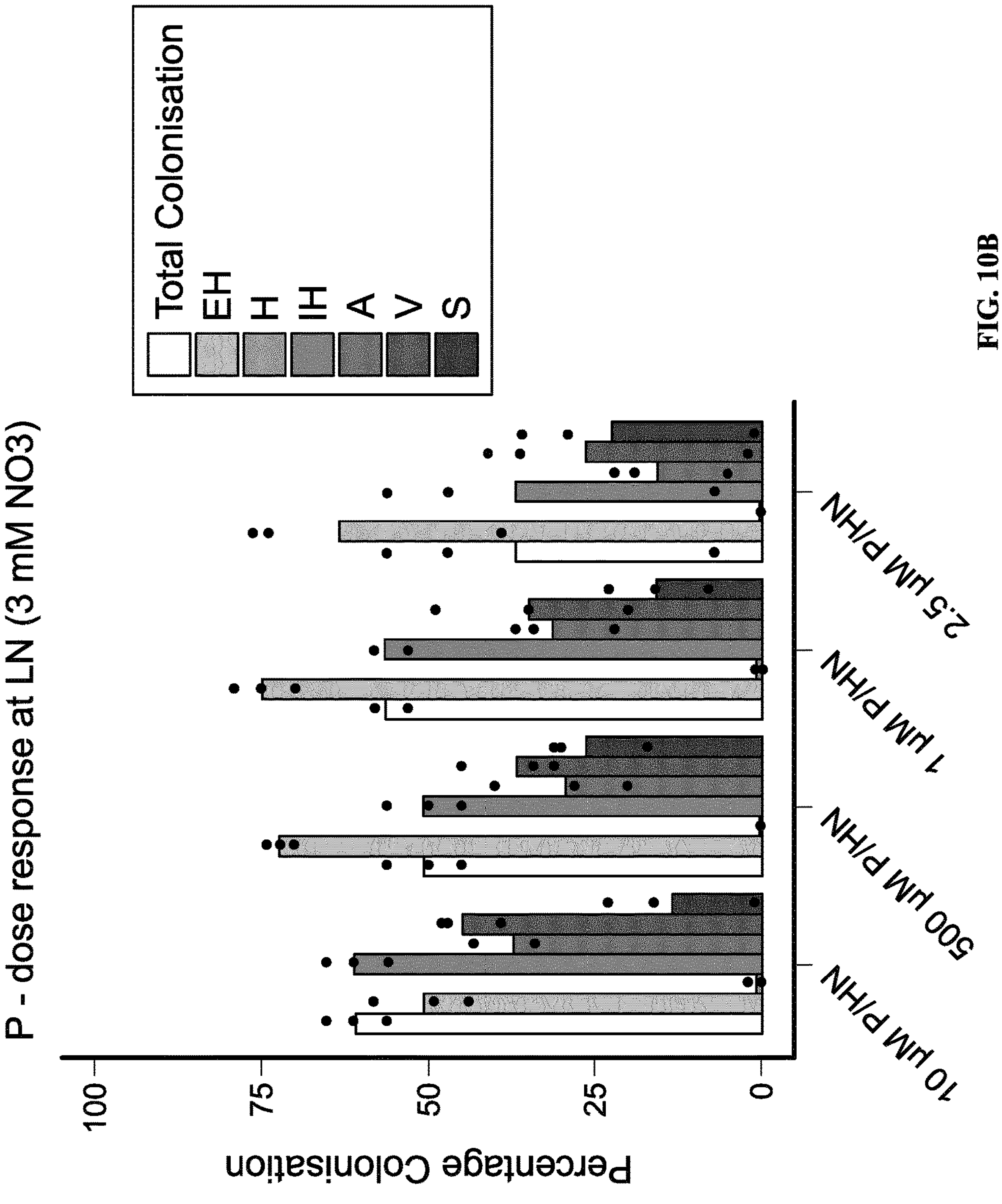
Figure 10C:
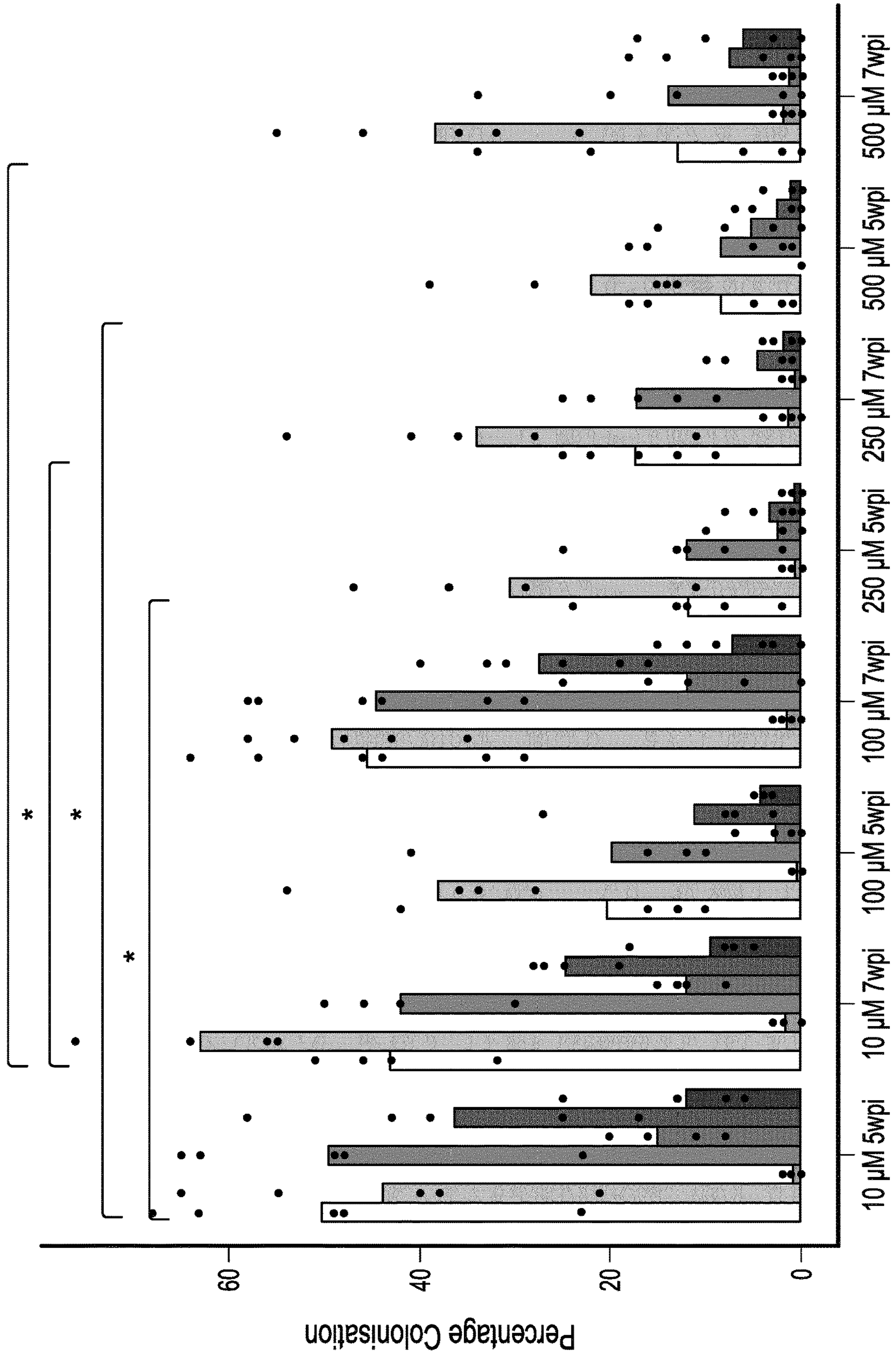

Phosphorus and nitrogen are the principal elemental nutrients in the soil that limit plant productivity, and the availability of these nutrients is important in both natural and agricultural ecosystems. In particular, the pools of these two nutrients that are available to plants (e.g., plant extractable, bioavailable) determines whether mycorrhization is suppressed. High phosphate levels (e.g., replete phosphate) and/or high nitrogen levels (e.g., replete nitrate) may suppress mycorrhization. The combination of both high phosphate and high nitrogen levels (e.g., replete phosphate and replete nitrate) is particularly potent in suppressing mycorrhization. FIG. 10A shows a dose response of phosphate levels in combination with high nitrate (3 mM) levels, and shows that increasing phosphate levels increasingly suppress mycorrhization in barley. Under high nitrate (3 mM) and high phosphate (2.5 mM) conditions, mycorrhization is almost fully suppressed. In comparison, FIG. 10B shows a dose response of the same phosphate levels at low nitrate (0.5 mM) levels, where a more subtle effect on fungal structures is observed. FIG. 10C shows another phosphate dose response, similar to FIG. 10A in using 3 mM nitrate but using lower levels of phosphate, in which significant suppression of mycorrhization in barley is seen at 250 μM to 500 μM phosphate. Both nitrogen and phosphorus have complex soil dynamics that integrate across mineral equilibria and micro-biological processes, and not all nitrogen and phosphorus in the soil is available to plants.

The total phosphorus pool includes a soluble phosphorus pool (proportionally very small) as well as a plant available pool (often <3% of the total pool). Bioavailable phosphorus is primarily available in soil in the form of phosphate ($PO_4^-$). There are a range of methods available for determining the amount of soluble phosphorus in soil (described in detail in Pierzynski (ed.), Methods for phosphorus analysis for soils, sediments, residuals, and waters. Southern Cooperative Series Bull. No. 408, June 2009, ISBN: 1-58161-408-x). Four commonly used soil phosphorus test methods are Bray and Kurtz P-1, Mehlich 1, Mehlich 3, and Olsen P (Carter, M. R., and E. G. Gregorich. 2007. Soil sampling and methods of analysis, second edition. CRC Press, Boca Raton, FL.; Frank, K., D. Beegle, and J. Denning. 1998. Phosphorus. p. 21-30. In J. R. Brown (ed.) Recommended Chemical Soil Test Procedures for the North Central Region. North Central Reg. Res. Publ. No. 221 (revised); Kuo, S. 1996. Phosphorus. p. 869-919. In D. L. Sparks. (ed.) Methods of Soil Analysis: Part 3—Chemical Methods. SSSA, Madison, WI.; SERA-IEG-6 (Southern Extension Research Activity—Information Exchange Group) 1992. Donohue, S. J. (ed.) Reference Soil and Media Diagnostic procedure for the southern region of the United States. So. Coop. Series Bulletin 374. Va. Agric. Exp. Station, Blacksburg, VA.; Sims, J. T., and A. M. Wolf. (ed.) 1995. Recommended soil testing procedures for the Northeastern United States. (2nd ed.). Bull. No. 493. Univ. Delaware, Newark, DE; SPAC (Soil and Plant Analysis Council). 1992. Handbook on reference methods for soil analysis. Georgia Univ. Stn., Athens, GA). The soil pH may be used to determine which method of these or others would be most advantageous to use (https://www.nres.usda.gov/Internet/FSE_DOCUMENTS/nresl42p2_051918.pdf). Additional commonly used soil phosphorus test methods include Morgan's and Modified Morgan's (Lunt, H. A., C. L. W. Swanson, and H. G. M. Jacobson. 1950. The Morgan Soil Testing System. Bull. No. 541, Conn. Agr. Exp. Stn., New Haven, CT; Morgan, M. F. 1941. Chemical soil diagnosis by the universal soil testing system. Conn. Agric. Exp. Stn. Bull. No. 450; SPAC (Soil and Plant Analysis Council). 1992. Handbook on reference methods for soil analysis. Georgia Univ. Stn., Athens, GA).

The total nitrogen pool is primarily composed of organic matter (about 98%) and referred to as the organic nitrogen fraction. The remaining about 2% of the total nitrogen pool is referred to as the mineral nitrogen pool, and is primarily present as nitrate ($NO_3^-$) or ammonium (NH4'). The mineral nitrogen pool is continually replenished by mineralisation processes, i.e., the conversion of organic to mineral forms, and is immediately plant available. Mineral nitrogen is used as a measure of the amount of bioavailable nitrogen in the soil. Commonly used tests to quantify immediately available mineral nitrogen are described in Maynard et al., Nitrate and Exchangeable Ammonium Nitrogen, Chapter 4, Soil Sampling and Methods of Analysis, M. R. Carter (ed.), Canadian Society of Soil Science and in https://www.udel.edu/content/dam/udelImages/canr/pdfs/extension/factsheets/soilt-est-recs/CHAP4.pdf. In addition to this immediately available mineral nitrogen pool, a proportion of the organic nitrogen pool is considered to be medium-term potentially available nitrogen for plants. This potentially available pool is generally thought to be composed of organic nitrogen that is converted to mineral nitrogen by microorganisms, but plants are also able to directly absorb free amino acids from the soil (Nasholm T, Kielland K, Ganeteg U. Uptake of organic nitrogen by plants. New Phytologist. 2009; 182:31-48; Hill P W, Quilliam R S, DeLuca T H, Farrar J, Farrell M, Roberts P, Newsham K K, Hopkins D W, Bardgett R D, Jones D L. Acquisition and assimilation of nitrogen as peptide-bound and D-enantiomers of amino acids by wheat. PLoS ONE. 2011; 6: e19220; Jones D L, Clode P L, Kilburn M R, Stockdale E A, Murphy D V. Competition between plant and bacterial cells at the microscale regulates the dynamics of nitrogen acquisition in wheat (*Triticum aestivum*) New Phytol. 2013 November; 200(3): 796-807; Jones D L, Shannon D, Junvee-Fortune T, Farrar J F. Plant capture of free amino acids is maximized under high soil amino acid concentrations. Soil Biol Biochem 2005; 37:179-81; Kielland K. Amino acid absorption by arctic plants: implications for plant nutrition and nitrogen cycling. Ecology 1994; 75:2373-83). The measurement of potentially available nitrogen is complex, and therefore generally not used as a measure of the amount of bioavailable nitrogen in the soil (Herrmann A M, Ritz K, Nunan N., Clode P L, Pett-Ridge J, Kilburn M R, Murphy D V, O'Donnell A G, Stockdale E A. Nano-scale secondary ion mass spectrometry A new analytical tool in biogeochemistry and soil ecology: A review article. Soil Biol Biochem 2007; 39(8): 1835-1850). Immediately and potentially available nitrogen pools together are usually less than 10% of the total nitrogen in soil.

In an additional embodiment of this aspect, which may be combined with any of the preceding embodiments, the plant is barley (e.g., *Hordeum vulgare*), maize (e.g., corn, *Zea mays*), rice (e.g., indica rice, *japonica* rice, aromatic rice, glutinous rice, *Oryza sativa, Oryza glaberrima*), wheat (e.g., common wheat, spelt, durum, einkorn, emmer, kamut, *Triticum aestivum, Triticum spelta, Triticum durum, Triticum urartu, Triticum monococcum, Triticum turanicum, Triticum* spp.), another cereal crop such as sorghum (e.g., *Sorghum bicolor*), millet (e.g., finger millet, fonio millet, foxtail millet, pearl millet, barnyard millets, *Eleusine coracana, Panicum sumatrense, Panicum milaceum, Setaria italica, Pennisetum glaucum, Digitaria* spp., *Echinocloa* spp.), teff (e.g., *Eragrostis tef*), oat (e.g., *Avena sativa*), triticale (e.g., X *Triticosecale* Wittmack, *Triticosecale schlanstedtense* Wittm., *Triticosecale neoblaringhemii* A. Camus, *Triticosecale neoblaringhemii* A. Camus), rye (e.g., *Secale cereale, Secale cereanum*), or wild rice (e.g., *Zizania* spp., *Porteresia* spp.), cassava (e.g., manioc, *yucca, Manihot esculenta*), potato (e.g., russet potatoes, yellow potatoes, red potatoes, *Solanum tuberosum*), soy (e.g., soybean, *soja*, sojabean, *Glycine max, Glycine soja*), or a legume crop such as peanut (e.g., *Arachis duranensis, Arachis hypogaea, Arachis ipaensis*), pigeon pea (e.g., *Cajanus cajan*), chickpea (e.g., *Cicer arietinum*), cowpea (e.g., black-eyed pea, *Vigna unguiculata*), velvet bean (e.g., *Mucuna pruriens*), bean (e.g., *Phaseolus vulgaris*), pea (e.g., *Pisum sativum*), adzuki bean (e.g., *Vigna angularis, Vigna angularis* var. *angularis*), mung bean (e.g., *Vigna radiata* var. *radiata*), clover (e.g., *Trifolium pratense, Trifolium subterraneum*), or lupine (e.g., lupin, *Lupinus angustifolius*). Yet another embodiment of this aspect includes the plant being barley (e.g., *Hordeum vulgare*).

In a further embodiment of this aspect, which may be combined with any of the preceding embodiments, the mycorrhization includes a symbiotic association of one or more plant parts selected from the group of a root system, a root, a root primordia, a root tip, a lateral root, a root meristem, or a root cell, with mycorrhizal fungi. An additional embodiment of this aspect includes the mycorrhizal fungi being selected from the group of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, or any combination thereof. In still another embodiment of this aspect, which may be combined with any of the preceding embodiments, increased mycorrhization enhances plant uptake of nutrients surround the plant roots selected from the group of phosphate, nitrate, or potassium, and increased mycorrhization optionally enhances plant uptake of water.

In an additional embodiment of this aspect, which may be combined with any of the preceding embodiments, symbiotic responses are induced by a plant's perception of LCOs produced by bacteria or fungi. Symbiotic responses are associated with the interactions of plants with beneficial microorganisms, including nitrogen-fixing bacteria and arbuscular mycorrhizal fungi (Oldroyd, G. E. D. Nature Reviews Microbiology 2013, 11), and may include symbiotic association of a plant with nitrogen-fixing bacteria (e.g., nodule formation), mycorrhizal fungi, or other beneficial commensal microorganisms. Symbiotic responses may also include the activation of the symbiosis (Sym) signaling pathway, and/or the presence of nuclear-associated calcium oscillations (also known as symbiotic calcium oscillations, or calcium spiking). In further embodiments of this aspect, which may be combined with any of the preceding embodiments, symbiotic responses include the activation of the expression of symbiosis-associated genes, such as HA1 or Vapyrin.

Yet another embodiment of this aspect, which may be combined with any of the preceding embodiments that does not have the nitrogen level around the plant roots being permissive of mycorrhization and/or symbiotic responses, further includes cultivating the genetically altered plant under conditions including a nitrogen level around the plant roots that suppresses mycorrhization and/or symbiotic responses, wherein the genetically altered plant of step a) further includes one or more genetic alterations that reduce the nitrogen level suppression of mycorrhization and/or symbiotic responses, and wherein step b) further includes cultivating the genetically altered plant under the nitrogen level around the plant roots, wherein the genetically altered plant has increased mycorrhization and/or promoted symbiotic responses as compared to a WT plant grown under the same conditions. In a further embodiment of this aspect, the one or more genetic alterations result in increased activity of a C-TERMINALLY ENCODED PEPTIDE (CEP peptide). In still another embodiment of this aspect, the increased activity is at least 10% greater, at least 15% greater, at least 20% greater, at least 25% greater, at least 30% greater, at least 35% greater, at least 40% greater, at least 45% greater, at least 50% greater, at least 55% greater, at least 60% greater, at least 65% greater, at least 70% greater, at least 75% greater, at least 80% greater, at least 85% greater, at least 90% greater, at least 95% greater, at least 100% greater, at least 110% greater, at least 120% greater, at least 130% greater, at least 140% greater, at least 150% greater, at least 160% greater, at least 170% greater, at least 180% greater, at least 190% greater, or at least 200% greater than the activity of the corresponding one or more proteins in the WT plant grown under the same conditions. In yet another embodiment of this aspect, which may be combined with any of the preceding embodiments that has the one or more genetic alterations resulting in increased activity of a CEP peptide, the increased activity is no greater than 500%, no greater than 475%, no greater than 450%, no greater than 425%, no greater than 400%, no greater than 375%, no greater than 350%, no greater than 325%, no greater than 300%, no greater than 275%, no greater than 250%, no greater than 225%, no greater than 200%, no greater than 175%, no greater than 150%, or no greater than 125% of the activity of the corresponding one or more proteins in the WT plant grown under the same conditions. In an additional embodiment of this aspect, which may be combined with any of the preceding embodiments that has the one or more genetic alterations resulting in increased activity of a CEP peptide, the CEP peptide includes an amino acid sequence with at least 70% sequence identity to, at least 71% sequence identity to, at least 72% sequence identity to, at least 73% sequence identity to, at least 74% sequence identity to, at least 75% sequence identity to, at least 76% sequence identity to, at least 77% sequence identity to, at least 78% sequence identity to, at least 79% sequence identity to, at least 80% sequence identity to, at least 81% sequence identity to, at least 82% sequence identity to, at least 83% sequence identity to, at least 84% sequence identity to, at least 85% sequence identity to, at least 86% sequence identity to, at least 87% sequence identity to, at least 88% sequence identity to, at least 89% sequence identity to, at least 90% sequence identity to, at least 91% sequence identity to, at least 92% sequence identity to, at least 93% sequence identity to, at least 94% sequence identity to, at least 95% sequence identity to, at least 96% sequence identity to, at least 97% sequence identity to, at least 98% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23. In a further embodiment of this aspect, the CEP peptide includes SEQ ID NO: 17, SEQ ID NO: 18, SEQ ID NO: 19, SEQ ID NO: 20, SEQ ID NO: 21, SEQ ID NO: 22, or SEQ ID NO: 23. In a further embodiment of this aspect, the CEP peptide is selected from the group of CEP1 (e.g., SEQ ID NO: 17), CEP2 (e.g., SEQ ID NO: 18), CEP3 (e.g., SEQ ID NO: 19), CEP4 (e.g., SEQ ID NO 20), CEP5 (e.g., SEQ ID NO: 21), CEP6 (e.g., SEQ ID NO: 22), or CEP7 (e.g., SEQ ID NO: 23). In an additional embodiment of this aspect, the CEP peptide is CEP3 (e.g., SEQ ID NO: 19). In still another embodiment of this aspect, which may be combined with any of the preceding embodiments that has the one or more genetic alterations resulting in increased activity of a CEP peptide, the CEP peptide is endogenous. Yet another embodiment of this aspect includes increased activity of the endogenous CEP peptide being achieved using a gene editing technique to introduce the one or more genetic alterations. An additional embodiment of this aspect includes the gene editing technique being selected from the group of transcription activator-like effector nuclease (TALEN) gene editing techniques, clustered Regularly Interspaced Short Palindromic Repeat (CRISPR/Cas) gene editing techniques, or zinc-finger nuclease (ZFN) gene editing techniques. In a further embodiment of this aspect, which may be combined with any of the preceding aspects that has a gene editing technique to introduce the one or more genetic alterations, the one or more genetic alterations that increase the activity of the endogenous protein are selected from the group of inactivating a repressor element that represses expression of the endogenous protein, removing a repressor element that represses expression of the endogenous protein, modulating the methylation state of a repressor element that represses expression of the endogenous protein, activating an enhancer element that increases expression of the endogenous protein, adding an enhancer element that increases expression of the endogenous protein, modulating the methylation state of an enhancer element that increases expression of the endogenous protein, adding a transcriptional activator recruiting or binding element that activates expression of the endogenous protein, replacing the endogenous promoter with an overexpression promoter that directs expression of the endogenous protein, modulating the methylation state of the endogenous promoter; modulating the methylation state of the endogenous coding sequence, adding elements that stabilize an endogenous mRNA encoding the endogenous protein, removing elements that destabilize the endogenous mRNA encoding the endogenous protein, modifying a coding sequence to increase stability of the endogenous protein, or modifying a coding sequence for the endogenous protein to increase activity of the endogenous protein. In still another embodiment of this aspect, which may be combined with any of the preceding embodiments that has the one or more genetic alterations resulting in increased activity of a CEP peptide, the increased activity is due to heterologous expression of the CEP peptide. An additional embodiment of this aspect includes increased activity of the heterologous CEP peptide being achieved using a vector including a first nucleic acid encoding the heterologous protein operably linked to a second nucleic acid encoding a promoter. A further embodiment of this aspect includes the promoter being selected from the group of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, or any combination thereof.

Yet another embodiment of this aspect, which may be combined with any of the preceding embodiments that does not have the nitrogen level around the plant roots being permissive of mycorrhization and/or symbiotic responses, further includes cultivating the genetically altered plant under conditions including a nitrogen level around the plant roots that suppresses mycorrhization and/or symbiotic responses, wherein step a) further includes cultivating the plant under conditions including the nitrogen level around the plant roots, and wherein step b) further includes exposing the plant or a part thereof to an effective amount of a CEP peptide, wherein the effective amount of the CEP peptide increases mycorrhization and/or promotes symbiotic responses in the plant or plant part as compared to the plant grown under the same conditions without the CEP peptide. In still another embodiment of this aspect, the effective amount of the CEP peptide includes at least 0.1 μM CEP peptide, at least 0.2 μM CEP peptide, at least 0.25 μM CEP peptide, at least 0.3 μM CEP peptide, at least 0.4 μM CEP peptide, at least 0.5 μM CEP peptide, at least 0.6 μM CEP peptide, at least 0.7 μM CEP peptide, at least 0.75 μM CEP peptide, at least 0.8 μM CEP peptide, at least 0.9 μM CEP peptide, at least 1 μM CEP peptide, at least 1.1 μM CEP peptide, at least 1.2 μM CEP peptide, at least 1.25 μM CEP peptide, at least 1.3 μM CEP peptide, at least 1.4 μM CEP peptide, at least 1.5 μM CEP peptide, at least 1.6 μM CEP peptide, at least 1.7 μM CEP peptide, at least 1.75 μM CEP peptide, at least 1.8 μM CEP peptide, at least 1.9 μM CEP peptide, or at least 2 μM CEP peptide. Further embodiments of this aspect, which may be combined with any of the preceding embodiments that have the plant or a part thereof being exposed to a CEP peptide, include the plant or the part thereof being exposed to the CEP peptide by direct application, application through irrigation or spraying, application in a seed coating, application in a seed coating with a mycorrhizal inoculum, or any combination thereof. In additional embodiments of this aspect, which may be combined with any of the preceding embodiments that have the plant or a part thereof being exposed to a CEP peptide, the CEP peptide includes an amino acid sequence with at least 70% sequence identity to, at least 71% sequence identity to, at least 72% sequence identity to, at least 73% sequence identity to, at least 74% sequence identity to, at least 75% sequence identity to, at least 76% sequence identity to, at least 77% sequence identity to, at least 78% sequence identity to, at least 79% sequence identity to, at least 80% sequence identity to, at least 81% sequence identity to, at least 82% sequence identity to, at least 83% sequence identity to, at least 84% sequence identity to, at least 85% sequence identity to, at least 86% sequence identity to, at least 87% sequence identity to, at least 88% sequence identity to, at least 89% sequence identity to, at least 90% sequence identity to, at least 91% sequence identity to, at least 92% sequence identity to, at least 93% sequence identity to, at least 94% sequence identity to, at least 95% sequence identity to, at least 96% sequence identity to, at least 97% sequence identity to, at least 98% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23. In yet another embodiment of this aspect, the CEP peptide includes SEQ ID NO: 17, SEQ ID NO: 18, SEQ ID NO: 19, SEQ ID NO: 20, SEQ ID NO: 21, SEQ ID NO: 22, or SEQ ID NO: 23 In a further embodiment of this aspect, the CEP peptide is selected from the group of CEP1 (e.g., SEQ ID NO: 17), CEP2 (e.g., SEQ ID NO: 18), CEP3 (e.g., SEQ ID NO: 19), CEP4 (e.g., SEQ ID NO 20), CEP5 (e.g., SEQ ID NO: 21), CEP6 (e.g., SEQ ID NO: 22), or CEP7 (e.g., SEQ ID NO: 23). In an additional embodiment of this aspect, the CEP peptide is CEP3 (e.g., SEQ ID NO: 19). Alignments of CEP proteins are shown in FIGS. 28A-28D. One of skill in the art would be able to identify CEP peptides from these CEP protein sequences. In still another embodiment of this aspect, which may be combined with any of the preceding embodiments that does not have the nitrogen level around the plant roots being permissive of mycorrhization and/or symbiotic responses, the nitrogen level around the plant roots completely suppresses mycorrhization and/or symbiotic responses in the WT plant grown under the same conditions. An additional embodiment of this aspect includes the nitrogen around the plant roots being present in the form of nitrate, and the nitrate level around the plant roots being greater than 2.75 mM, greater than 2.8 mM, greater than 2.9 mM, greater than 3 mM, greater than 3.1 mM, greater than 3.2 mM, greater than 3.25 mM, greater than 3.3 mM, greater than 3.4 mM, greater than 3.5 mM, greater than 3.6 mM, greater than 3.7 mM, greater than 3.75 mM, greater than 3.8 mM, greater than 3.9 mM, greater than 4 mM, greater than 4.1 mM, greater than 4.2 mM, greater than 4.25 mM, greater than 4.3 mM, greater than 4.4 mM, greater than 4.5 mM, greater than 4.6 mM, greater than 4.7 mM, greater than 4.75 mM, greater than 4.8 mM, greater than 4.9 mM, greater than 5 mM, greater than 5.25 mM, or greater than 5.5 mM.

Figure 11A:
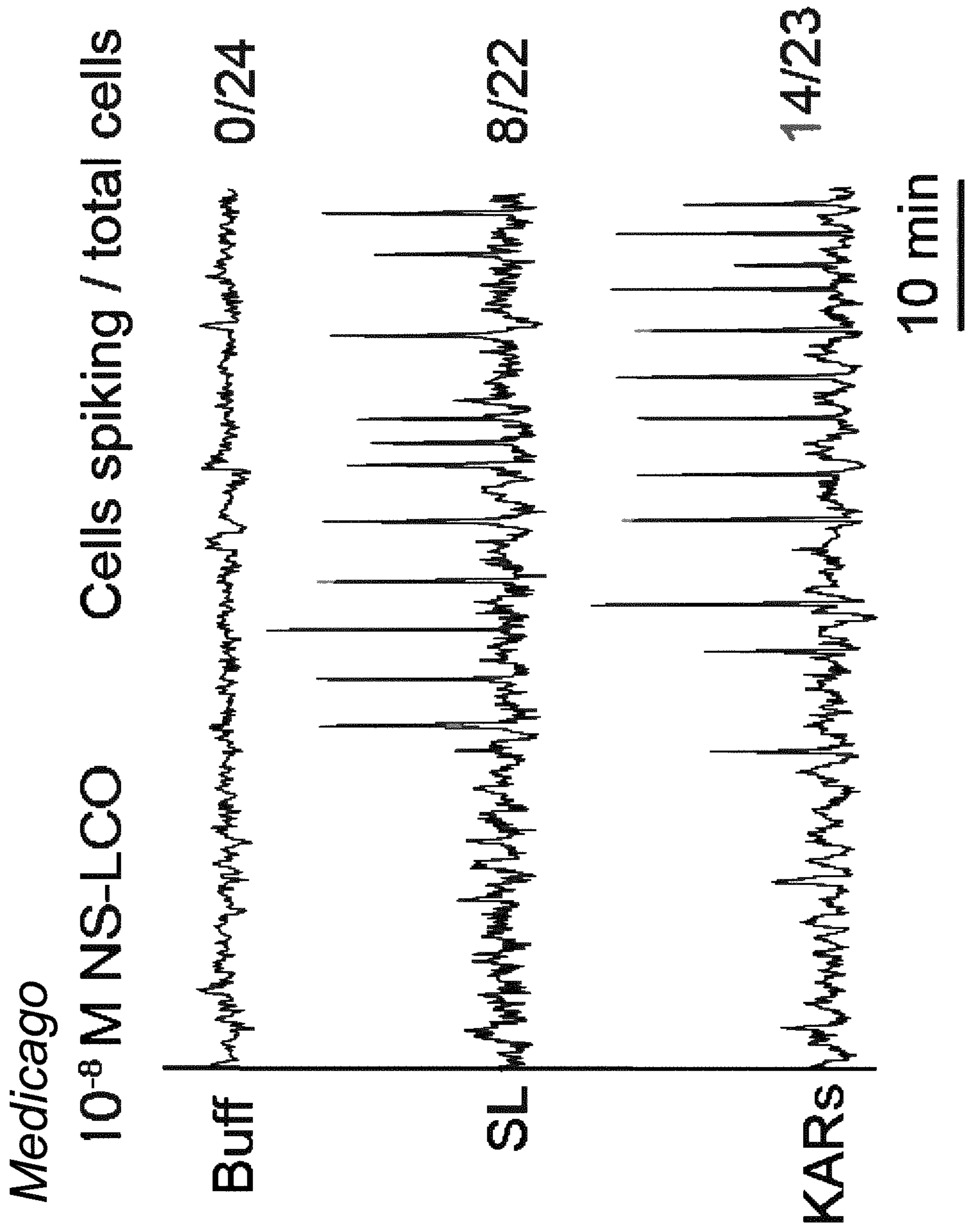
FIGS. 11A-11B provide the effects of strigolactone or karrikin treatment on *M. truncatula* (FIG. 11A) and *H. vulgare* (FIG. 11B) root epidermal cell nuclear calcium oscillations.
Figure 11B:
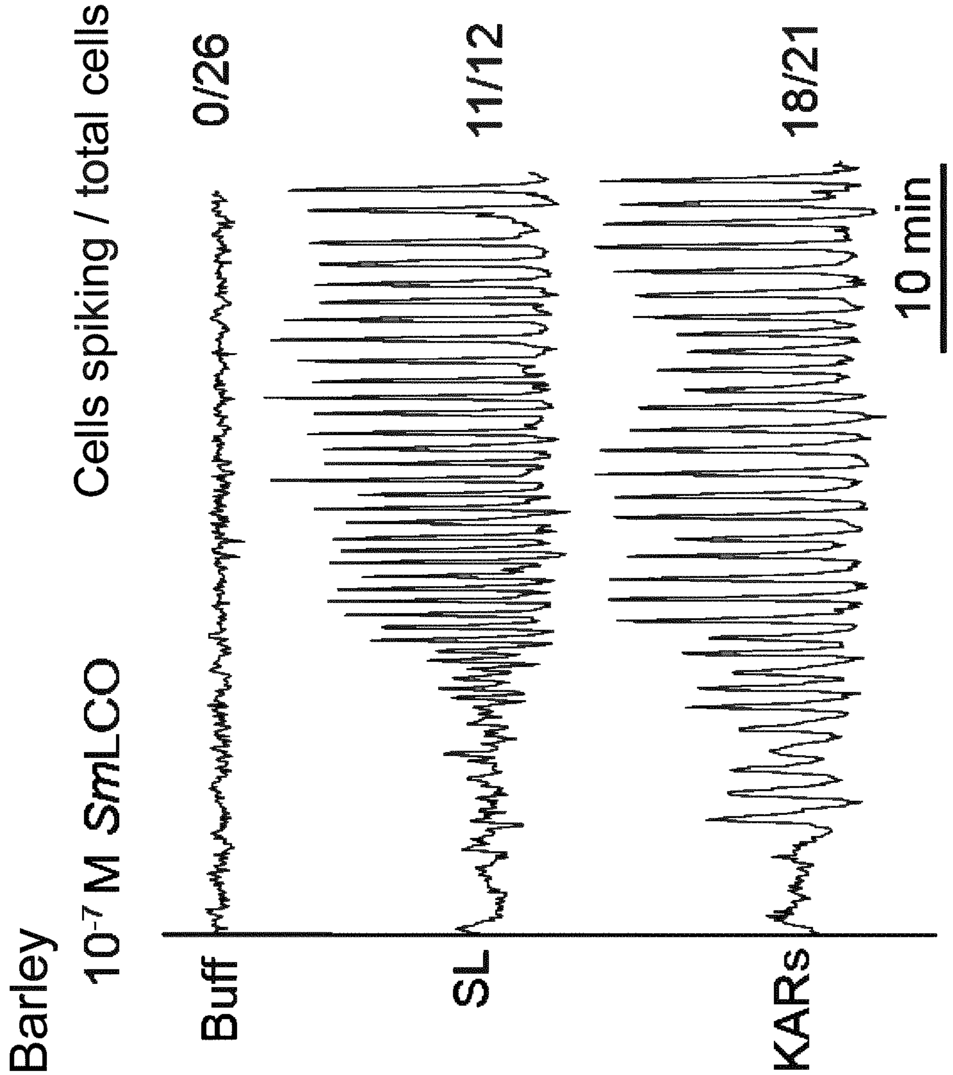

An additional aspect of the disclosure includes methods of cultivating a plant with increased mycorrhization and/or promoted symbiotic responses under conditions including a phosphate level around the plant roots that suppresses mycorrhization and/or symbiotic responses, including: (a) cultivating the plant under conditions including the phosphate level around the plant roots; and (b) exposing the plant or a part thereof to an effective amount of a butenolide agent, wherein the effective amount of the butenolide agent increases mycorrhization and/or promotes symbiotic responses in the plant or plant part as compared to the plant grown under the same conditions without the butenolide agent. In yet another embodiment of this aspect, the effective amount of the butenolide agent includes at least 0.1 μM butenolide agent, at least 0.2 μM butenolide agent, at least 0.25 μM butenolide agent, at least 0.3 μM butenolide agent, at least 0.4 μM butenolide agent, at least 0.5 μM butenolide agent, at least 0.6 μM butenolide agent, at least 0.7 μM butenolide agent, at least 0.75 μM butenolide agent, at least 0.8 μM butenolide agent, at least 0.9 μM butenolide agent, at least 1 μM butenolide agent, at least 1.1 μM butenolide agent, at least 1.2 μM butenolide agent, at least 1.25 μM butenolide agent, at least 1.3 μM butenolide agent, at least 1.4 μM butenolide agent, at least 1.5 μM butenolide agent, at least 1.6 μM butenolide agent, at least 1.7 μM butenolide agent, at least 1.75 μM butenolide agent, at least 1.8 μM butenolide agent, at least 1.9 μM butenolide agent, or at least 2 μM butenolide agent. A further embodiment of this aspect includes the plant or the part thereof being exposed to the butenolide agent by direct application, application through irrigation or spraying, application in a seed coating, application in a seed coating with a mycorrhizal inoculum, or any combination thereof. Yet another embodiment of this aspect, which may be combined with any of the preceding embodiments, includes the butenolide agent being a strigolactone. Still another embodiment of this aspect includes the strigolactone being selected from the group of 5-deoxystrigol, strigol, sorgomol, sorgolactone, other strigol-like compounds, 4-deoxyorobanchol, orobanchol, fabacyl acetate, solanocol, other orobanchol-like compounds, GR24, or any combination thereof. An additional embodiment of this aspect, which may be combined with any of the preceding embodiments, includes the butenolide agent being a karrikin. Yet another embodiment of this aspect includes the karrikin being selected from the group of karrikin1 ($KAR_1$), karrikin2 ($KAR_2$), karrikin3 ($KAR_3$), karrikin4 ($KAR_4$), karrikin5 ($KAR_5$), karrikin6 ($KAR_6$), a mixture of karrikin1 and karrikin2 ($KAR_1$+$KAR_2$), GR24, karrikin contained in liquid smoke, or any combination thereof. A further embodiment of this aspect includes the karrikin being karrikin1 ($KAR_1$), karrikin2 ($KAR_2$), or a mixture of karrikin1 and karrikin2 ($KAR_1$+$KAR_2$). GR24 is a synthetic strigolactone analog that activates both strigolactone and karrikin signaling pathways. The effect of treatment with strigolactones or karrikins on LCO-induced (i.e., symbiotic) nuclear calcium oscillations in *M. truncatula* is shown in FIG. 11A, and the effect in *H. vulgare* is shown in FIG. 11B.

Still another embodiment of this aspect, which may be combined with any of the preceding embodiments, includes the phosphate level around the plant roots completely suppressing mycorrhization and/or symbiotic responses in the plant grown under the same conditions without the butenolide agent. In an additional embodiment of this aspect, includes the phosphate level around the plant roots inhibits mycorrhization and/or symbiotic responses in the plant grown under the same conditions without the butenolide agent. In a further embodiment of this aspect, which may be combined with any of the preceding embodiments, the nitrogen level around the plant roots is permissive of mycorrhization and/or symbiotic responses in the plant grown under the same conditions without the butenolide agent. In yet another embodiment of this aspect, the nitrogen around the plant roots is present in the form of nitrate, and the nitrate level around the plant roots is less than 2.5 mM, less than 2.4 mM, less than 2.3 mM, less than 2.2 mM, less than 2.1 mM, less than 2.0 mM, less than 1.9 mM, less than 1.8 mM, less than 1.7 mM, less than 1.6 mM, less than 1.5 mM, less than 1.4 mM, less than 1.3 mM, less than 1.2 mM, less than 1.1 mM, less than 1.0 mM, less than 0.95 mM, less than 0.9 mM, less than 0.85 mM, less than 0.8 mM, less than 0.75 mM, less than 0.7 mM, less than 0.65 mM, less than 0.6 mM, less than 0.55 mM, less than 0.5 mM, less than 0.45 mM, less than 0.4 mM, less than 0.35 mM, less than 0.3 mM, less than 0.25 mM, less than 0.2 mM, less than 0.15 mM, less than 0.1 mM, or less than 0.05 mM. In yet another embodiment of this aspect, the nitrate level around the plant roots is about 0 mM. In an additional embodiment of this aspect, which may be combined with any of the preceding embodiments, the phosphate level around the plant roots includes at least 100 μM phosphate, at least 125 μM phosphate, at least 150 μM phosphate, at least 175 μM phosphate, at least 200 μM phosphate, at least 225 μM phosphate, at least 250 μM phosphate, at least 275 μM phosphate, at least 300 μM phosphate, at least 325 μM phosphate, at least 350 μM phosphate, at least 375 μM phosphate, at least 400 μM phosphate, at least 425 μM phosphate, at least 450 μM phosphate, at least 475 μM phosphate, at least 500 μM phosphate, at least 525 μM phosphate, at least 550 μM phosphate, at least 575 μM phosphate, at least 600 μM phosphate, at least 625 μM phosphate, at least 650 μM phosphate, at least 675 μM phosphate, at least 700 μM phosphate, at least 725 μM phosphate, at least 750 μM phosphate, at least 800 μM phosphate, at least 850 μM phosphate, at least 900 μM phosphate, at least 950 μM phosphate, at least 1000 μM phosphate, at least 1250 μM phosphate, at least 1500 μM phosphate, at least 1750 μM phosphate, at least 2000 μM phosphate, at least 2250 μM phosphate, at least 2500 μM phosphate, at least 2750 μM phosphate, at least 3000 μM phosphate, at least 3250 μM phosphate, at least 3500 μM phosphate, at least 3750 μM phosphate, at least 4000 μM phosphate, at least 4250 μM phosphate, at least 4500 μM phosphate, at least 4750 μM phosphate, or at least 5000 μM phosphate. In yet another embodiment of this aspect, which may be combined with any of the preceding embodiments, the plant is barley (e.g., *Hordeum vulgare*), maize (e.g., corn, *Zea mays*), rice (e.g., indica rice, *japonica* rice, aromatic rice, glutinous rice, *Oryza sativa, Oryza glaberrima*), wheat (e.g., common wheat, spelt, durum, einkorn, emmer, kamut, *Triticum aestivum, Triticum spelta, Triticum durum, Triticum urartu, Triticum monococcum, Triticum turanicum, Triticum* spp.), another cereal crop such as sorghum (e.g., *Sorghum bicolor*), millet (e.g., finger millet, fonio millet, foxtail millet, pearl millet, barnyard millets, *Eleusine coracana, Panicum sumatrense, Panicum milaceum, Setaria italica, Pennisetum glaucum, Digitaria* spp., *Echinocloa* spp.), teff (e.g., *Eragrostis tef*), oat (e.g., *Avena sativa*), triticale (e.g., X *Triticosecale* Wittmack, *Triticosecale schlanstedtense* Wittm., *Triticosecale neoblaringhemii* A. Camus, *Triticosecale neo-*

*blaringhemii* A. Camus), rye (e.g., *Secale cereale, Secale cereanum*), or wild rice (e.g., *Zizania* spp., *Porteresia* spp.), cassava (e.g., manioc, *yucca, Manihot esculenta*), potato (e.g., russet potatoes, yellow potatoes, red potatoes, *Solanum tuberosum*), soy (e.g., soybean, *soja*, sojabean, *Glycine max, Glycine soja*), or a legume crop such as peanut (e.g., *Arachis duranensis, Arachis hypogaea, Arachis ipaensis*), pigeon pea (e.g., *Cajanus cajan*), chickpea (e.g., *Cicer arietinum*), cowpea (e.g., black-eyed pea, *Vigna unguiculata*), velvet bean (e.g., *Mucuna pruriens*), bean (e.g., *Phaseolus vulgaris*), pea (e.g., *Pisum sativum*), adzuki bean (e.g., *Vigna angularis, Vigna angularis* var. *angularis*), mung bean (e.g., *Vigna radiata* var. *radiata*), clover (e.g., *Trifolium pratense, Trifolium subterraneum*), or lupine (e.g., lupin, *Lupinus angustifolius*). Yet another embodiment of this aspect includes the plant being barley (e.g., *Hordeum vulgare*).

In a further embodiment of this aspect, which may be combined with any of the preceding embodiments, the mycorrhization includes a symbiotic association of one or more plant parts selected from the group of a root system, a root, a root primordia, a root tip, a lateral root, a root meristem, or a root cell, with mycorrhizal fungi. An additional embodiment of this aspect includes the mycorrhizal fungi being selected from the group of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, or any combination thereof. In still another embodiment of this aspect, which may be combined with any of the preceding embodiments, increased mycorrhization enhances plant uptake of nutrients surround the plant roots selected from the group of phosphate, nitrate, or potassium, and increased mycorrhization optionally enhances plant uptake of water.

In an additional embodiment of this aspect, which may be combined with any of the preceding embodiments, symbiotic responses are induced by a plant's perception of LCOs produced by bacteria or fungi. Symbiotic responses are associated with the interactions of plants with beneficial microorganisms, including nitrogen-fixing bacteria and arbuscular mycorrhizal fungi (Oldroyd, G. E. D. Nature Reviews Microbiology 2013, 11), and may include symbiotic association of a plant with nitrogen-fixing bacteria (e.g., nodule formation), mycorrhizal fungi, or other beneficial commensal microorganisms. Symbiotic responses may also include the activation of the symbiosis (Sym) signaling pathway, and/or the presence of nuclear-associated calcium oscillations (also known as symbiotic calcium oscillations, or calcium spiking). In further embodiments of this aspect, which may be combined with any of the preceding embodiments, symbiotic responses include the activation of the expression of symbiosis-associated genes, such as HA1 or Vapyrin.

Yet another embodiment of this aspect, which may be combined with any of the preceding embodiments that does not have the nitrogen level around the plant roots being permissive of mycorrhization and/or symbiotic responses, further includes cultivating the genetically altered plant under conditions including a nitrogen level around the plant roots that suppresses mycorrhization and/or symbiotic responses, wherein the genetically altered plant of step a) further includes one or more genetic alterations that reduce the nitrogen level suppression of mycorrhization and/or symbiotic responses, and wherein step b) further includes cultivating the genetically altered plant under the nitrogen level around the plant roots, wherein the genetically altered plant has increased mycorrhization and/or promoted symbiotic responses as compared to a WT plant grown under the same conditions. In a further embodiment of this aspect, the one or more genetic alterations result in increased activity of a CEP peptide. In still another embodiment of this aspect, the increased activity is at least 10% greater, at least 15% greater, at least 20% greater, at least 25% greater, at least 30% greater, at least 35% greater, at least 40% greater, at least 45% greater, at least 50% greater, at least 55% greater, at least 60% greater, at least 65% greater, at least 70% greater, at least 75% greater, at least 80% greater, at least 85% greater, at least 90% greater, at least 95% greater, at least 100% greater, at least 110% greater, at least 120% greater, at least 130% greater, at least 140% greater, at least 150% greater, at least 160% greater, at least 170% greater, at least 180% greater, at least 190% greater, or at least 200% greater than the activity of the corresponding one or more proteins in the WT plant grown under the same conditions. In yet another embodiment of this aspect, which may be combined with any of the preceding embodiments that has the one or more genetic alterations resulting in increased activity of a CEP peptide, the increased activity is no greater than 500%, no greater than 475%, no greater than 450%, no greater than 425%, no greater than 400%, no greater than 375%, no greater than 350%, no greater than 325%, no greater than 300%, no greater than 275%, no greater than 250%, no greater than 225%, no greater than 200%, no greater than 175%, no greater than 150%, or no greater than 125% of the activity of the corresponding one or more proteins in the WT plant grown under the same conditions. In an additional embodiment of this aspect, which may be combined with any of the preceding embodiments that has the one or more genetic alterations resulting in increased activity of a CEP peptide, the CEP peptide includes an amino acid sequence with at least 70% sequence identity to, at least 71% sequence identity to, at least 72% sequence identity to, at least 73% sequence identity to, at least 74% sequence identity to, at least 75% sequence identity to, at least 76% sequence identity to, at least 77% sequence identity to, at least 78% sequence identity to, at least 79% sequence identity to, at least 80% sequence identity to, at least 81% sequence identity to, at least 82% sequence identity to, at least 83% sequence identity to, at least 84% sequence identity to, at least 85% sequence identity to, at least 86% sequence identity to, at least 87% sequence identity to, at least 88% sequence identity to, at least 89% sequence identity to, at least 90% sequence identity to, at least 91% sequence identity to, at least 92% sequence identity to, at least 93% sequence identity to, at least 94% sequence identity to, at least 95% sequence identity to, at least 96% sequence identity to, at least 97% sequence identity to, at least 98% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23. In a further embodiment of this aspect, the CEP peptide includes SEQ ID NO: 17, SEQ ID NO: 18, SEQ ID NO: 19, SEQ ID NO: 20, SEQ ID NO: 21, SEQ ID NO: 22, or SEQ ID NO: 23. In a further embodiment of this aspect, the CEP peptide is selected from the group of CEP1 (e.g., SEQ ID NO: 17), CEP2 (e.g., SEQ ID NO: 18), CEP3 (e.g., SEQ ID NO: 19), CEP4 (e.g., SEQ ID NO 20), CEP5 (e.g., SEQ ID NO: 21), CEP6 (e.g., SEQ ID NO: 22), or CEP7 (e.g., SEQ ID NO: 23). In an additional embodiment of this aspect, the CEP peptide is CEP3 (e.g., SEQ ID NO: 19). In still another embodiment of this aspect, which may be combined with any of the preceding embodiments that has the one or more genetic alterations resulting in increased activity of a CEP peptide, the CEP peptide is endogenous. Yet another embodiment of this aspect includes increased activity of the endogenous CEP peptide being achieved using a gene editing technique to introduce the one or more genetic alterations. An additional embodiment of this aspect includes the gene editing technique being selected from the group of transcription activator-like effector nuclease (TALEN) gene editing techniques, clustered Regularly Interspaced Short Palindromic Repeat (CRISPR/Cas) gene editing techniques, or zinc-finger nuclease (ZFN) gene editing techniques. In a further embodiment of this aspect, which may be combined with any of the preceding aspects that has a gene editing technique to introduce the one or more genetic alterations, the one or more genetic alterations that increase the activity of the endogenous protein are selected from the group of inactivating a repressor element that represses expression of the endogenous protein, removing a repressor element that represses expression of the endogenous protein, modulating the methylation state of a repressor element that represses expression of the endogenous protein, activating an enhancer element that increases expression of the endogenous protein, adding an enhancer element that increases expression of the endogenous protein, modulating the methylation state of an enhancer element that increases expression of the endogenous protein, adding a transcriptional activator recruiting or binding element that activates expression of the endogenous protein, replacing the endogenous promoter with an overexpression promoter that directs expression of the endogenous protein, modulating the methylation state of the endogenous promoter; modulating the methylation state of the endogenous coding sequence, adding elements that stabilize an endogenous mRNA encoding the endogenous protein, removing elements that destabilize the endogenous mRNA encoding the endogenous protein, modifying a coding sequence to increase stability of the endogenous protein, or modifying a coding sequence for the endogenous protein to increase activity of the endogenous protein. In still another embodiment of this aspect, which may be combined with any of the preceding embodiments that has the one or more genetic alterations resulting in increased activity of a CEP peptide, the increased activity is due to heterologous expression of the CEP peptide. An additional embodiment of this aspect includes increased activity of the heterologous CEP peptide being achieved using a vector including a first nucleic acid encoding the heterologous protein operably linked to a second nucleic acid encoding a promoter. A further embodiment of this aspect includes the promoter being selected from the group of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, or any combination thereof.

Yet another embodiment of this aspect, which may be combined with any of the preceding embodiments that does not have the nitrogen level around the plant roots being permissive of mycorrhization and/or symbiotic responses, further includes cultivating the genetically altered plant under conditions including a nitrogen level around the plant roots that suppresses mycorrhization and/or symbiotic responses, wherein step a) further includes cultivating the plant under conditions including the nitrogen level around the plant roots, and wherein step b) further includes exposing the plant or a part thereof to an effective amount of a CEP peptide, wherein the effective amount of the CEP peptide increases mycorrhization and/or promotes symbiotic responses in the plant or plant part as compared to the plant grown under the same conditions without the CEP peptide. In still another embodiment of this aspect, the effective amount of the CEP peptide includes at least 0.1 μM CEP peptide, at least 0.2 μM CEP peptide, at least 0.25 μM CEP peptide, at least 0.3 μM CEP peptide, at least 0.4 μM CEP peptide, at least 0.5 μM CEP peptide, at least 0.6 μM CEP peptide, at least 0.7 μM CEP peptide, at least 0.75 μM CEP peptide, at least 0.8 μM CEP peptide, at least 0.9 μM CEP peptide, at least 1 μM CEP peptide, at least 1.1 μM CEP peptide, at least 1.2 μM CEP peptide, at least 1.25 μM CEP peptide, at least 1.3 μM CEP peptide, at least 1.4 μM CEP peptide, at least 1.5 μM CEP peptide, at least 1.6 μM CEP peptide, at least 1.7 μM CEP peptide, at least 1.75 μM CEP peptide, at least 1.8 μM CEP peptide, at least 1.9 μM CEP peptide, or at least 2 μM CEP peptide. Further embodiments of this aspect, which may be combined with any of the preceding embodiments that have the plant or a part thereof being exposed to a CEP peptide, include the plant or the part thereof being exposed to the CEP peptide by direct application, application through irrigation or spraying, application in a seed coating, application in a seed coating with a mycorrhizal inoculum, or any combination thereof. In additional embodiments of this aspect, which may be combined with any of the preceding embodiments that have the plant or a part thereof being exposed to a CEP peptide, the CEP peptide includes an amino acid sequence with at least 70% sequence identity to, at least 71% sequence identity to, at least 72% sequence identity to, at least 73% sequence identity to, at least 74% sequence identity to, at least 75% sequence identity to, at least 76% sequence identity to, at least 77% sequence identity to, at least 78% sequence identity to, at least 79% sequence identity to, at least 80% sequence identity to, at least 81% sequence identity to, at least 82% sequence identity to, at least 83% sequence identity to, at least 84% sequence identity to, at least 85% sequence identity to, at least 86% sequence identity to, at least 87% sequence identity to, at least 88% sequence identity to, at least 89% sequence identity to, at least 90% sequence identity to, at least 91% sequence identity to, at least 92% sequence identity to, at least 93% sequence identity to, at least 94% sequence identity to, at least 95% sequence identity to, at least 96% sequence identity to, at least 97% sequence identity to, at least 98% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23. In yet another embodiment of this aspect, the CEP peptide includes SEQ ID NO: 17, SEQ ID NO: 18, SEQ ID NO: 19, SEQ ID NO: 20, SEQ ID NO: 21, SEQ ID NO: 22, or SEQ ID NO: 23. In a further embodiment of this aspect, the CEP peptide is selected from the group of CEP1 (e.g., SEQ ID NO: 17), CEP2 (e.g., SEQ ID NO: 18), CEP3 (e.g., SEQ ID NO: 19), CEP4 (e.g., SEQ ID NO 20), CEP5 (e.g., SEQ ID NO: 21), CEP6 (e.g., SEQ ID NO: 22), or CEP7 (e.g., SEQ ID NO: 23). In an additional embodiment of this aspect, the CEP peptide is CEP3 (e.g., SEQ ID NO: 19). In still another embodiment of this aspect, which may be combined with any of the preceding embodiments that does not have the nitrogen level around the plant roots being permissive of mycorrhization and/or symbiotic responses, the nitrogen level around the plant roots completely suppresses mycorrhization and/or symbiotic responses in the WT plant grown under the same conditions. In a further embodiment of this aspect, the nitrogen level around the plant roots inhibits mycorrhization and/or symbiotic responses in the WT plant grown under the same conditions. An additional embodiment of this aspect includes the nitrogen around the plant roots being present in the form of nitrate, and the nitrate level around the plant roots being greater than 2.75 mM, greater than 2.8 mM, greater than 2.9 mM, greater than 3 mM, greater than 3.1 mM, greater than 3.2 mM, greater than 3.25 mM, greater than 3.3 mM, greater than 3.4 mM, greater than 3.5 mM, greater than 3.6 mM, greater than 3.7 mM, greater than 3.75 mM, greater than 3.8 mM, greater than 3.9 mM, greater than 4 mM, greater than 4.1 mM, greater than 4.2 mM, greater than 4.25 mM, greater than 4.3 mM, greater than 4.4 mM, greater than 4.5 mM, greater than 4.6 mM, greater than 4.7 mM, greater than 4.75 mM, greater than 4.8 mM, greater than 4.9 mM, greater than 5 mM, greater than 5.25 mM, or greater than 5.5 mM.

A further aspect of the disclosure includes methods of cultivating a genetically altered plant with increased mycorrhization and/or promoted symbiotic responses under conditions including a nitrogen level around the plant roots that suppresses mycorrhization and/or symbiotic responses, including: (a) providing the genetically altered plant, wherein the plant or a part thereof includes one or more genetic alterations, wherein the one or more genetic alterations reduce the nitrogen level suppression of mycorrhization and/or symbiotic responses; and (b) cultivating the genetically altered plant under the nitrogen level around the plant roots, wherein the genetically altered plant has increased mycorrhization and/or promoted symbiotic responses as compared to a WT plant grown under the same conditions. In an additional embodiment of this aspect, the one or more genetic alterations result in increased activity of a CEP peptide. Yet another embodiment of this aspect includes the increased activity being at least 10% greater, at least 15% greater, at least 20% greater, at least 25% greater, at least 30% greater, at least 35% greater, at least 40% greater, at least 45% greater, at least 50% greater, at least 55% greater, at least 60% greater, at least 65% greater, at least 70% greater, at least 75% greater, at least 80% greater, at least 85% greater, at least 90% greater, at least 95% greater, at least 100% greater, at least 110% greater, at least 120% greater, at least 130% greater, at least 140% greater, at least 150% greater, at least 160% greater, at least 170% greater, at least 180% greater, at least 190% greater, or at least 200% greater than the activity of the corresponding one or more proteins in the WT plant grown under the same conditions. Still another embodiment of this aspect, which may be combined with any of the preceding embodiments that has the one or more genetic alterations resulting in increased activity, the increased activity is no greater than 500%, no greater than 475%, no greater than 450%, no greater than 425%, no greater than 400%, no greater than 375%, no greater than 350%, no greater than 325%, no greater than 300%, no greater than 275%, no greater than 250%, no greater than 225%, no greater than 200%, no greater than 175%, no greater than 150%, or no greater than 125% of the activity of the corresponding one or more proteins in the WT plant grown under the same conditions. In a further embodiment of this aspect, the CEP peptide is selected from the group of CEP1 (e.g., SEQ ID NO: 17), CEP2 (e.g., SEQ ID NO: 18), CEP3 (e.g., SEQ ID NO: 19), CEP4 (e.g., SEQ ID NO 20), CEP5 (e.g., SEQ ID NO: 21), CEP6 (e.g., SEQ ID NO: 22), or CEP7 (e.g., SEQ ID NO: 23). In an additional embodiment of this aspect, the CEP peptide is CEP3 (e.g., SEQ ID NO: 19). In an additional embodiment of this aspect, which may be combined with any of the preceding embodiments that has the one or more genetic alterations resulting in increased activity, the CEP peptide includes an amino acid sequence with at least 70% sequence identity to, at least 71% sequence identity to, at least 72% sequence identity to, at least 73% sequence identity to, at least 74% sequence identity to, at least 75% sequence identity to, at least 76% sequence identity to, at least 77% sequence identity to, at least 78% sequence identity to, at least 79% sequence identity to, at least 80% sequence identity to, at least 81% sequence identity to, at least 82% sequence identity to, at least 83% sequence identity to, at least 84% sequence identity to, at least 85% sequence identity to, at least 86% sequence identity to, at least 87% sequence identity to, at least 88% sequence identity to, at least 89% sequence identity to, at least 90% sequence identity to, at least 91% sequence identity to, at least 92% sequence identity to, at least 93% sequence identity to, at least 94% sequence identity to, at least 95% sequence identity to, at least 96% sequence identity to, at least 97% sequence identity to, at least 98% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23. In yet another embodiment of this aspect, the CEP peptide includes SEQ ID NO: 17, SEQ ID NO: 18, SEQ ID NO: 19, SEQ ID NO: 20, SEQ ID NO: 21, SEQ ID NO: 22, or SEQ ID NO: 23.

In still another embodiment of this aspect, which may be combined with any of the preceding embodiments that has the one or more genetic alterations resulting in increased activity, the CEP peptide is endogenous. A further embodiment of this aspect includes increased activity of the CEP peptide being achieved using a gene editing technique to introduce the one or more genetic alterations. An additional embodiment of this aspect includes the gene editing technique being selected from the group of transcription activator-like effector nuclease (TALEN) gene editing techniques, clustered Regularly Interspaced Short Palindromic Repeat (CRISPR/Cas) gene editing techniques, or zinc-finger nuclease (ZFN) gene editing techniques. In an additional embodiment of this aspect, which may be combined with any of the preceding embodiments that has a gene editing technique to introduce the one or more genetic alterations, the one or more genetic alterations that increase the activity of the endogenous protein are selected from the group of inactivating a repressor element that represses expression of the endogenous protein, removing a repressor element that represses expression of the endogenous protein, modulating the methylation state of a repressor element that represses expression of the endogenous protein, activating an enhancer element that increases expression of the endogenous protein, adding an enhancer element that increases expression of the endogenous protein, modulating the methylation state of an enhancer element that increases expression of the endogenous protein, adding a transcriptional activator recruiting or binding element that activates expression of the endogenous protein, replacing the endogenous promoter with an overexpression promoter that directs expression of the endogenous protein, modulating the methylation state of the endogenous promoter, modulating the methylation state of the endogenous coding sequence, adding elements that stabilize an endogenous mRNA encoding the endogenous protein, removing elements that destabilize the endogenous mRNA encoding the endogenous protein, modifying a coding sequence to increase stability of the endogenous protein, or modifying a coding sequence for the endogenous protein to increase activity of the endogenous protein.

In yet another embodiment of this aspect, which may be combined with any of the preceding embodiments that has the one or more genetic alterations resulting in increased activity, the increased activity is due to heterologous expression of the CEP peptide. In a further embodiment of this aspect, increased activity of the heterologous CEP peptide is achieved using a vector including a first nucleic acid encoding the heterologous protein operably linked to a second nucleic acid encoding a promoter. An additional embodiment of this aspect includes the promoter being selected from the group of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, or any combination thereof.

In an additional embodiment of this aspect, which may be combined with any of the preceding embodiments, the nitrogen level around the plant roots completely suppresses mycorrhization and/or symbiotic responses in the WT plant grown under the same conditions. In a further embodiment of this aspect, the nitrogen level around the plant roots inhibits mycorrhization and/or symbiotic responses in the WT plant grown under the same conditions. In still another embodiment of this aspect, which may be combined with any of the preceding embodiments, the phosphate level around the plant roots is permissive of mycorrhization and/or symbiotic responses in the WT plant grown under the same conditions. In yet another embodiment of this aspect, the phosphate level around the plant roots includes less than 1000 μM phosphate, less than 950 μM phosphate, less than 900 μM phosphate, less than 850 μM phosphate, less than 800 μM phosphate, less than 750 μM phosphate, less than 725 μM phosphate, less than 700 μM phosphate, less than 675 μM phosphate, less than 650 μM phosphate, less than 625 μM phosphate, less than 600 μM phosphate, less than 575 μM phosphate, less than 550 μM phosphate, less than 525 μM phosphate, less than 500 μM phosphate, less than 475 μM phosphate, less than 450 μM phosphate, less than 425 μM phosphate, less than 400 μM phosphate, less than 375 μM phosphate, less than 350 μM phosphate, less than 325 μM phosphate, less than 300 μM phosphate, less than 275 μM phosphate, less than 250 μM phosphate, less than 225 μM phosphate, less than 200 μM phosphate, less than 175 μM phosphate, less than 150 μM phosphate, less than 125 μM phosphate, less than 100 μM phosphate, or less than 50 μM phosphate. In yet another embodiment of this aspect, the phosphate level around the plant roots is about 0 μM. In an additional embodiment of this aspect, which may be combined with any of the preceding embodiments, the nitrogen around the plant roots is present in the form of nitrate, and the nitrate level around the plant roots is greater than 2.75 mM, greater than 2.8 mM, greater than 2.9 mM, greater than 3 mM, greater than 3.1 mM, greater than 3.2 mM, greater than 3.25 mM, greater than 3.3 mM, greater than 3.4 mM, greater than 3.5 mM, greater than 3.6 mM, greater than 3.7 mM, greater than 3.75 mM, greater than 3.8 mM, greater than 3.9 mM, greater than 4 mM, greater than 4.1 mM, greater than 4.2 mM, greater than 4.25 mM, greater than 4.3 mM, greater than 4.4 mM, greater than 4.5 mM, greater than 4.6 mM, greater than 4.7 mM, greater than 4.75 mM, greater than 4.8 mM, greater than 4.9 mM, greater than 5 mM, greater than 5.25 mM, or greater than 5.5 mM. In still another embodiment of this aspect, which may be combined with any of the preceding embodiments, the plant is barley (e.g., *Hordeum vulgare*), maize (e.g., corn, *Zea mays*), rice (e.g., indica rice, *japonica* rice, aromatic rice, glutinous rice, *Oryza sativa, Oryza glaberrima*), wheat (e.g., common wheat, spelt, durum, einkorn, emmer, kamut, *Triticum aestivum, Triticum spelta, Triticum durum, Triticum urartu, Triticum monococcum, Triticum turanicum, Triticum* spp.), another cereal crop such as sorghum (e.g., *Sorghum bicolor*), millet (e.g., finger millet, fonio millet, foxtail millet, pearl millet, barnyard millets, *Eleusine coracana, Panicum sumatrense, Panicum milaceum, Setaria italica, Pennisetum glaucum, Digitaria* spp., *Echinocloa* spp.), teff (e.g., *Eragrostis tef*), oat (e.g., *Avena sativa*), triticale (e.g., X *Triticosecale* Wittmack, *Triticosecale schlanstedtense* Wittm., *Triticosecale neoblaringhemii* A. Camus, *Triticosecale neoblaringhemii* A. Camus), rye (e.g., *Secale cereale, Secale cereanum*), or wild rice (e.g., *Zizania* spp., *Porteresia* spp.), cassava (e.g., manioc, *yucca, Manihot esculenta*), potato (e.g., russet potatoes, yellow potatoes, red potatoes, *Solanum tuberosum*), soy (e.g., soybean, *soja*, sojabean, *Glycine max, Glycine soja*), or a legume crop such as peanut (e.g., *Arachis duranensis, Arachis hypogaea, Arachis ipaensis*), pigeon pea (e.g., *Cajanus cajan*), chickpea (e.g., *Cicer arietinum*), cowpea (e.g., black-eyed pea, *Vigna unguiculata*), velvet bean (e.g., *Mucuna pruriens*), bean (e.g., *Phaseolus vulgaris*), pea (e.g., *Pisum sativum*), adzuki bean (e.g., *Vigna angularis, Vigna angularis* var. *angularis*), mung bean (e.g., *Vigna radiata* var. *radiata*), clover (e.g., *Trifolium pratense, Trifolium subterraneum*), or lupine (e.g., lupin, *Lupinus angustifolius*). Yet another embodiment of this aspect includes the plant being barley (e.g., *Hordeum vulgare*).

In still another embodiment of this aspect, which may be combined with any of the preceding embodiments, the mycorrhization includes a symbiotic association of one or more plant parts selected from the group of a root system, a root, a root primordia, a root tip, a lateral root, a root meristem, or a root cell, with mycorrhizal fungi. An additional embodiment of this aspect includes the mycorrhizal fungi being selected from the group of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, or any combination thereof. In still another embodiment of this aspect, which may be combined with any of the preceding embodiments, increased mycorrhization enhances plant uptake of nutrients surround the plant roots selected from the group of phosphate, nitrate, or potassium, and increased mycorrhization optionally enhances plant uptake of water.

In an additional embodiment of this aspect, which may be combined with any of the preceding embodiments, symbiotic responses are induced by a plant's perception of LCOs produced by bacteria or fungi. Symbiotic responses are associated with the interactions of plants with beneficial microorganisms, including nitrogen-fixing bacteria and arbuscular mycorrhizal fungi (Oldroyd, G. E. D. Nature Reviews Microbiology 2013, 11), and may include symbiotic association of a plant with nitrogen-fixing bacteria (e.g., nodule formation), mycorrhizal fungi, or other beneficial commensal microorganisms. Symbiotic responses may also include the activation of the symbiosis (Sym) signaling pathway, and/or the presence of nuclear-associated calcium oscillations (also known as symbiotic calcium oscillations, or calcium spiking). In further embodiments of this aspect, which may be combined with any of the preceding embodiments, symbiotic responses include the activation of the expression of symbiosis-associated genes, such as HA1 or Vapyrin.

A further aspect of this disclosure includes methods of cultivating a plant with increased mycorrhization and/or promoted symbiotic responses under conditions including a nitrogen level around the plant roots that suppresses mycorrhization and/or symbiotic responses, including: (a) cultivating the plant under conditions including the nitrogen level around the plant roots; and (b) exposing the plant or a part thereof to an effective amount of a CEP peptide, wherein the effective amount of the CEP peptide increases mycorrhization and/or promotes symbiotic responses in the plant or plant part as compared to the plant grown under the same conditions without the CEP peptide. In an additional embodiment of this aspect, the effective amount of the CEP peptide at least 0.1 μM CEP peptide, at least 0.2 μM CEP peptide, at least 0.25 μM CEP peptide, at least 0.3 μM CEP peptide, at least 0.4 μM CEP peptide, at least 0.5 μM CEP peptide, at least 0.6 μM CEP peptide, at least 0.7 μM CEP peptide, at least 0.75 μM CEP peptide, at least 0.8 μM CEP peptide, at least 0.9 μM CEP peptide, at least 1 μM CEP peptide, at least 1.1 μM CEP peptide, at least 1.2 μM CEP peptide, at least 1.25 μM CEP peptide, at least 1.3 μM CEP peptide, at least 1.4 μM CEP peptide, at least 1.5 μM CEP peptide, at least 1.6 μM CEP peptide, at least 1.7 μM CEP peptide, at least 1.75 μM CEP peptide, at least 1.8 μM CEP peptide, at least 1.9 μM CEP peptide, or at least 2 μM CEP peptide. In yet another embodiment of this aspect, which may be combined with any of the preceding embodiments, the plant or the part thereof is exposed to the CEP peptide by direct application, application through irrigation or spraying, application in a seed coating, application in a seed coating with a mycorrhizal inoculum, or any combination thereof. In still another embodiment of this aspect, which may be combined with any of the preceding embodiments, the CEP peptide includes an amino acid sequence with at least 70% sequence identity to, at least 71% sequence identity to, at least 72% sequence identity to, at least 73% sequence identity to, at least 74% sequence identity to, at least 75% sequence identity to, at least 76% sequence identity to, at least 77% sequence identity to, at least 78% sequence identity to, at least 79% sequence identity to, at least 80% sequence identity to, at least 81% sequence identity to, at least 82% sequence identity to, at least 83% sequence identity to, at least 84% sequence identity to, at least 85% sequence identity to, at least 86% sequence identity to, at least 87% sequence identity to, at least 88% sequence identity to, at least 89% sequence identity to, at least 90% sequence identity to, at least 91% sequence identity to, at least 92% sequence identity to, at least 93% sequence identity to, at least 94% sequence identity to, at least 95% sequence identity to, at least 96% sequence identity to, at least 97% sequence identity to, at least 98% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23. In a further embodiment of this aspect, which may be combined with any of the preceding embodiments, the CEP peptide includes SEQ ID NO: 17, SEQ ID NO: 18, SEQ ID NO: 19, SEQ ID NO: 20, SEQ ID NO: 21, SEQ ID NO: 22, or SEQ ID NO: 23. In a further embodiment of this aspect, the CEP peptide is selected from the group of CEP1 (e.g., SEQ ID NO: 17), CEP2 (e.g., SEQ ID NO: 18), CEP3 (e.g., SEQ ID NO: 19), CEP4 (e.g., SEQ ID NO 20), CEP5 (e.g., SEQ ID NO: 21), CEP6 (e.g., SEQ ID NO: 22), or CEP7 (e.g., SEQ ID NO: 23). In an additional embodiment of this aspect, the CEP peptide is CEP3 (e.g., SEQ ID NO: 19).

In yet another embodiment of this aspect, which may be combined with any of the preceding embodiments, the nitrogen level around the plant roots completely suppresses mycorrhization and/or symbiotic responses in the plant grown under the same conditions without the CEP peptide. In a further embodiment of this aspect, the nitrogen level around the plant roots inhibits mycorrhization and/or symbiotic responses in the plant grown under the same conditions without the CEP peptide. In an additional embodiment of this aspect, which may be combined with any of the preceding embodiments, the phosphate level around the plant roots is permissive of mycorrhization and/or symbiotic responses in the plant grown under the same conditions without the CEP peptide. In a further embodiment of this aspect, the phosphate level around the plant roots includes less than 1000 μM phosphate, less than 950 μM phosphate, less than 900 μM phosphate, less than 850 μM phosphate, less than 800 μM phosphate, less than 750 μM phosphate, less than 725 μM phosphate, less than 700 μM phosphate, less than 675 μM phosphate, less than 650 μM phosphate, less than 625 μM phosphate, less than 600 μM phosphate, less than 575 μM phosphate, less than 550 μM phosphate, less than 525 μM phosphate, less than 500 μM phosphate, less than 475 μM phosphate, less than 450 μM phosphate, less than 425 μM phosphate, less than 400 μM phosphate, less than 375 μM phosphate, less than 350 μM phosphate, less than 325 μM phosphate, less than 300 μM phosphate, less than 275 μM phosphate, less than 250 μM phosphate, less than 225 μM phosphate, less than 200 μM phosphate, less than 175 μM phosphate, less than 150 μM phosphate, less than 125 μM phosphate, less than 100 μM phosphate, or less than 50 μM phosphate. In yet another embodiment of this aspect, the phosphate level around the plant roots is about 0 μM. In still another embodiment of this aspect, which may be combined with any of the preceding embodiments, the nitrogen around the plant roots is present in the form of nitrate, and the nitrate level around the plant roots is greater than 2.75 mM, greater than 2.8 mM, greater than 2.9 mM, greater than 3 mM, greater than 3.1 mM, greater than 3.2 mM, greater than 3.25 mM, greater than 3.3 mM, greater than 3.4 mM, greater than 3.5 mM, greater than 3.6 mM, greater than 3.7 mM, greater than 3.75 mM, greater than 3.8 mM, greater than 3.9 mM, greater than 4 mM, greater than 4.1 mM, greater than 4.2 mM, greater than 4.25 mM, greater than 4.3 mM, greater than 4.4 mM, greater than 4.5 mM, greater than 4.6 mM, greater than 4.7 mM, greater than 4.75 mM, greater than 4.8 mM, greater than 4.9 mM, greater than 5 mM, greater than 5.25 mM, or greater than 5.5 mM. In a further embodiment of this aspect, which may be combined with any of the preceding embodiments, the plant is barley (e.g., *Hordeum vulgare*), maize (e.g., corn, *Zea mays*), rice (e.g., indica rice, *japonica* rice, aromatic rice, glutinous rice, *Oryza sativa, Oryza glaberrima*), wheat (e.g., common wheat, spelt, durum, einkorn, emmer, kamut, *Triticum aestivum, Triticum spelta, Triticum durum, Triticum urartu, Triticum monococcum, Triticum turanicum, Triticum* spp.), another cereal crop such as sorghum (e.g., *Sorghum bicolor*), millet (e.g., finger millet, fonio millet, foxtail millet, pearl millet, barnyard millets, *Eleusine coracana, Panicum sumatrense, Panicum milaceum, Setaria italica, Pennisetum glaucum, Digitaria* spp., *Echinocloa* spp.), teff (e.g., *Eragrostis tef*), oat (e.g., *Avena sativa*), triticale (e.g., X *Triticosecale* Wittmack, *Triticosecale schlanstedtense* Wittm., *Triticosecale neoblaringhemii* A. Camus, *Triticose-*

*cale neoblaringhemii* A. Camus), rye (e.g., *Secale cereale, Secale cereanum*), or wild rice (e.g., *Zizania* spp., *Porteresia* spp.), cassava (e.g., manioc, *yucca, Manihot esculenta*), potato (e.g., russet potatoes, yellow potatoes, red potatoes, *Solanum tuberosum*), soy (e.g., soybean, *soja*, sojabean, *Glycine max, Glycine soja*), or a legume crop such as peanut (e.g., *Arachis duranensis, Arachis hypogaea, Arachis ipaensis*), pigeon pea (e.g., *Cajanus cajan*), chickpea (e.g., *Cicer arietinum*), cowpea (e.g., black-eyed pea, *Vigna unguiculata*), velvet bean (e.g., *Mucuna pruriens*), bean (e.g., *Phaseolus vulgaris*), pea (e.g., *Pisum sativum*), adzuki bean (e.g., *Vigna angularis, Vigna angularis* var. *angularis*), mung bean (e.g., *Vigna radiata* var. *radiata*), clover (e.g., *Trifolium pratense, Trifolium subterraneum*), or lupine (e.g., lupin, *Lupinus angustifolius*). An additional embodiment of this aspect includes the plant being (e.g., *Hordeum vulgare*).

In still another embodiment of this aspect, which may be combined with any of the preceding embodiments, the mycorrhization includes a symbiotic association of one or more plant parts selected from the group of a root system, a root, a root primordia, a root tip, a lateral root, a root meristem, or a root cell, with mycorrhizal fungi. An additional embodiment of this aspect includes the mycorrhizal fungi being selected from the group of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, or any combination thereof. In still another embodiment of this aspect, which may be combined with any of the preceding embodiments, increased mycorrhization enhances plant uptake of nutrients surround the plant roots selected from the group of phosphate, nitrate, or potassium, and increased mycorrhization optionally enhances plant uptake of water.

In an additional embodiment of this aspect, which may be combined with any of the preceding embodiments, symbiotic responses are induced by a plant's perception of LCOs produced by bacteria or fungi. Symbiotic responses are associated with the interactions of plants with beneficial microorganisms, including nitrogen-fixing bacteria and arbuscular mycorrhizal fungi (Oldroyd, G. E. D. Nature Reviews Microbiology 2013, 11), and may include symbiotic association of a plant with nitrogen-fixing bacteria (e.g., nodule formation), mycorrhizal fungi, or other beneficial commensal microorganisms. Symbiotic responses may also include the activation of the symbiosis (Sym) signaling pathway, and/or the presence of nuclear-associated calcium oscillations (also known as symbiotic calcium oscillations, or calcium spiking). In further embodiments of this aspect, which may be combined with any of the preceding embodiments, symbiotic responses include the activation of the expression of symbiosis-associated genes, such as HA1 or Vapyrin.

Methods of Producing Genetically Altered Plants

An additional aspect of this disclosure includes methods of producing the genetically altered plant of any of the preceding embodiments that has increased activity of NSP1 or NSP2, including: (a) transforming a plant cell, tissue, or other explant with a vector including a first nucleic acid sequence encoding a NSP1 protein or a NSP2 protein operably linked to a second nucleic acid sequence encoding a promoter; (b) selecting successful transformation events by means of a selection agent, marker-assisted selection, or selective media; (c) regenerating the transformed cell, tissue, or other explant into a genetically altered plantlet; and (d) growing the genetically altered plantlet into a genetically altered plant with increased activity of the NSP1 protein or the NSP2 protein as compared to an untransformed WT plant. Yet another embodiment of this aspect further includes identifying successful introduction of the one or more genetic alterations by screening or selecting the plant cell, tissue, or other explant prior to step (b); screening or selecting plantlets between step (b) and (c); or screening or selecting plants after step (c). Still another embodiment of this aspect, which may be combined with any preceding embodiments, includes transformation being done using a transformation method selected from the group of particle bombardment (i.e., biolistics, gene gun), *Agrobacterium*-mediated transformation, *Rhizobium*-mediated transformation, or protoplast transfection or transformation. In an additional embodiment of this aspect, which may be combined with any of the preceding embodiments, the NSP1 protein includes an amino acid sequence with at least 70% sequence identity to, at least 71% sequence identity to, at least 72% sequence identity to, at least 73% sequence identity to, at least 74% sequence identity to, at least 75% sequence identity to, at least 76% sequence identity to, at least 77% sequence identity to, at least 78% sequence identity to, at least 79% sequence identity to, at least 80% sequence identity to, at least 81% sequence identity to, at least 82% sequence identity to, at least 83% sequence identity to, at least 84% sequence identity to, at least 85% sequence identity to, at least 86% sequence identity to, at least 87% sequence identity to, at least 88% sequence identity to, at least 89% sequence identity to, at least 90% sequence identity to, at least 91% sequence identity to, at least 92% sequence identity to, at least 93% sequence identity to, at least 94% sequence identity to, at least 95% sequence identity to, at least 96% sequence identity to, at least 97% sequence identity to, at least 98% sequence identity to, or at least 99% sequence identity to SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207; or the NSP2 protein includes an amino acid sequence with at least 70% sequence identity to, at least 71% sequence identity to, at least 72% sequence identity to, at least 73% sequence identity to, at least 74% sequence identity to, at least 75% sequence identity to, at least 76% sequence identity to, at least 77% sequence identity to, at least 78% sequence identity to, at least 79% sequence identity to, at least 80% sequence identity to, at least 81% sequence identity to, at least 82% sequence identity to, at least 83% sequence identity to, at least 84% sequence identity to, at least 85% sequence identity to, at least 86% sequence identity to, at least 87% sequence identity to, at least 88% sequence identity to, at least 89% sequence identity to, at least 90% sequence identity to, at least 91% sequence identity to, at least 92% sequence identity to, at least 93% sequence identity to, at least 94% sequence identity to, at least 95% sequence identity to, at least 96% sequence identity to, at least 97% sequence identity to, at least 98% sequence identity to, or at least 99% sequence identity to SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208. In a further embodiment of this aspect, the NSP1 protein includes SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 89, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 174, SEQ ID NO: 176, SEQ ID NO: 177, SEQ ID NO: 178, SEQ ID NO: 179, SEQ ID NO: 180, or SEQ ID NO: 207; or the NSP2 protein includes SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 151, SEQ ID NO: 152, SEQ ID NO: 153, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 175, SEQ ID NO: 181, SEQ ID NO: 182, SEQ ID NO: 183, SEQ ID NO: 184, SEQ ID NO: 185, SEQ ID NO: 186, SEQ ID NO: 187, or SEQ ID NO: 208. In yet another embodiment of this aspect, which may be combined with any preceding embodiments, the promoter is selected from the group of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, or any combination thereof. In still another embodiment of this aspect, which may be combined with any preceding embodiments, the first nucleic acid sequence and the second nucleic acid sequence are stably integrated into a nuclear genome of the plant.

A further aspect of this disclosure includes methods of producing the genetically altered plant of any of the preceding embodiments that has increased activity of NSP1 or NSP2, including (a) transforming a plant cell, tissue, or other explant with one or more gene editing components that target a nuclear genome sequence operably linked to an endogenous NSP1 protein or an endogenous NSP2 protein; (b) selecting successful transformation events by means of a screening technology, an enriching technology, a selection agent, marker-assisted selection, or selective media; (c) regenerating the transformed cell, tissue, or other explant into a genetically altered plantlet; and (d) growing the genetically altered plantlet into a genetically altered plant with overexpression of the NSP1 protein or the NSP2 protein as compared to an untransformed WT plant. In an additional embodiment of this aspect, the one or more gene editing components include a ribonucleoprotein complex that targets the nuclear genome sequence; a vector including a TALEN protein encoding sequence, wherein the TALEN protein targets the nuclear genome sequence; a vector including a ZFN protein encoding sequence, wherein the ZFN protein targets the nuclear genome sequence; an oligonucleotide donor (OND), wherein the OND targets the nuclear genome sequence; or a vector CRISPR/Cas enzyme encoding sequence and a targeting sequence, wherein the targeting sequence targets the nuclear genome sequence.

An additional aspect of this disclosure includes methods of producing the genetically altered plant of any of the preceding embodiments that has increased activity of CEP peptide, including: (a) transforming a plant cell, tissue, or other explant with a vector including a first nucleic acid sequence encoding a CEP peptide operably linked to a second nucleic acid sequence encoding a promoter; (b) selecting successful transformation events by means of a selection agent, marker-assisted selection, or selective media; (c) regenerating the transformed cell, tissue, or other explant into a genetically altered plantlet; and (d) growing the genetically altered plantlet into a genetically altered plant with increased activity of the CEP peptide as compared to an untransformed WT plant. Yet another embodiment of this aspect further includes identifying successful introduction of the one or more genetic alterations by screening or selecting the plant cell, tissue, or other explant prior to step (b); screening or selecting plantlets between step (b) and (c); or screening or selecting plants after step (c). Still another embodiment of this aspect, which may be combined with any preceding embodiments, includes transformation being done using a transformation method selected from the group of particle bombardment (i.e., biolistics, gene gun), *Agrobacterium*-mediated transformation, *Rhizobium*-mediated transformation, or protoplast transfection or transformation. In an additional embodiment of this aspect, which may be combined with any of the preceding embodiments, the CEP peptide includes an amino acid sequence with at least 70% sequence identity to, at least 71% sequence identity to, at least 72% sequence identity to, at least 73% sequence identity to, at least 74% sequence identity to, at least 75% sequence identity to, at least 76% sequence identity to, at least 77% sequence identity to, at least 78% sequence identity to, at least 79% sequence identity to, at least 80% sequence identity to, at least 81% sequence identity to, at least 82% sequence identity to, at least 83% sequence identity to, at least 84% sequence identity to, at least 85% sequence identity to, at least 86% sequence identity to, at least 87% sequence identity to, at least 88% sequence identity to, at least 89% sequence identity to, at least 90% sequence identity to, at least 91% sequence identity to, at least 92% sequence identity to, at least 93% sequence identity to, at least 94% sequence identity to, at least 95% sequence identity to, at least 96% sequence identity to, at least 97% sequence identity to, at least 98% sequence identity to, or at least 99% sequence identity to SEQ ID NO: 17, SEQ ID NO: 18, SEQ ID NO: 19, SEQ ID NO: 20, SEQ ID NO: 21, SEQ ID NO: 22, or SEQ ID NO: 23. In a further embodiment of this aspect, the CEP peptide includes SEQ ID NO: 17, SEQ ID NO: 18, SEQ ID NO: 19, SEQ ID NO: 20, SEQ ID NO: 21, SEQ ID NO: 22, or SEQ ID NO: 23. In a further embodiment of this aspect, the CEP peptide is selected from the group of CEP1 (e.g., SEQ ID NO: 17), CEP2 (e.g., SEQ ID NO: 18), CEP3 (e.g., SEQ ID NO: 19), CEP4 (e.g., SEQ ID NO 20), CEP5 (e.g., SEQ ID NO: 21), CEP6 (e.g., SEQ ID NO: 22), or CEP7 (e.g., SEQ ID NO: 23). In an additional embodiment of this aspect, the CEP peptide is CEP3 (e.g., SEQ ID NO: 19). In yet another embodiment of this aspect, which may be combined with any preceding embodiments, the promoter is selected from the group of a CaMV35S promoter, a ubiquitin promoter, a pBdUBI10 promoter, a pPvUBI2 promoter, a pPvUBI1 promoter, a pZmUBI promoter, a pOsPGD1 promoter, a p35s promoter, a pOsUBI3 promoter, a pBdEF1α promoter, a pAtUBI10 promoter, a pOsAct1 promoter, a pOsRS2 promoter, a pZmEF1α promoter, a pZmTUB1α promoter, a pHvIDS2 promoter, a ZmRsyn7 promoter, a pSiCCaMK promoter, or any combination thereof. In still another embodiment of this aspect, which may be combined with any preceding embodiments, the first nucleic acid sequence and the second nucleic acid sequence are stably integrated into a nuclear genome of the plant.

A further aspect of this disclosure includes methods of producing the genetically altered plant of any of the preceding embodiments that has increased activity of CEP peptide, including (a) transforming a plant cell, tissue, or other explant with one or more gene editing components that target a nuclear genome sequence operably linked to an endogenous CEP peptide; (b) selecting successful transformation events by means of a screening technology, an enriching technology, a selection agent, marker-assisted selection, or selective media; (c) regenerating the transformed cell, tissue, or other explant into a genetically altered plantlet; and (d) growing the genetically altered plantlet into a genetically altered plant with overexpression of the CEP peptide as compared to an untransformed WT plant. In an additional embodiment of this aspect, the one or more gene editing components include a ribonucleoprotein complex that targets the nuclear genome sequence; a vector including a TALEN protein encoding sequence, wherein the TALEN protein targets the nuclear genome sequence; a vector including a ZFN protein encoding sequence, wherein the ZFN protein targets the nuclear genome sequence; an oligonucleotide donor (OND), wherein the OND targets the nuclear genome sequence; or a vector CRISPR/Cas enzyme encoding sequence and a targeting sequence, wherein the targeting sequence targets the nuclear genome sequence.

Molecular Biological Methods to Produce Genetically Altered Plants and Plant Cells One embodiment of the present invention provides genetically altered plants or plant cells containing one or more genetic alterations, which increase activity of one or more of a NODULATION SIGNALING PATHWAY 1 (NSP1) protein or a NODULATION SIGNALING PATHWAY 2 (NSP2) protein. In addition, the present disclosure provides genetically altered plants or plant cells containing one or more genetic alterations that increase activity of CEP peptides.

Transformation and generation of genetically altered monocotyledonous and dicotyledonous plant cells is well known in the art. See, e.g., Weising, et al., Ann. Rev. Genet. 22:421-477 (1988); U.S. Pat. No. 5,679,558; *Agrobacterium* Protocols, ed: Gartland, Humana Press Inc. (1995); and Wang, et al. Acta Hort. 461:401-408 (1998). The choice of method varies with the type of plant to be transformed, the particular application and/or the desired result. The appropriate transformation technique is readily chosen by the skilled practitioner.

Any methodology known in the art to delete, insert or otherwise modify the cellular DNA (e.g., genomic DNA and organelle DNA) can be used in practicing the inventions disclosed herein. For example, a disarmed Ti plasmid, containing a genetic construct for deletion or insertion of a target gene, in *Agrobacterium tumefaciens* can be used to transform a plant cell, and thereafter, a transformed plant can be regenerated from the transformed plant cell using procedures described in the art, for example, in EP 0116718, EP 0270822, PCT publication WO 84/02913 and published European Patent application ("EP") 0242246. Ti-plasmid vectors each contain the gene between the border sequences, or at least located to the left of the right border sequence, of the T-DNA of the Ti-plasmid. Of course, other types of vectors can be used to transform the plant cell, using procedures such as direct gene transfer (as described, for example in EP 0233247), pollen mediated transformation (as described, for example in EP 0270356, PCT publication WO 85/01856, and U.S. Pat. No. 4,684,611), plant RNA virus-mediated transformation (as described, for example in EP 0 067 553 and U.S. Pat. No. 4,407,956), liposome-mediated transformation (as described, for example in U.S. Pat. No. 4,536,475), and other methods such as the methods for transforming certain lines of corn (e.g., U.S. Pat. No. 6,140,553; Fromm et al., Bio/Technology (1990) 8, 833-839); Gordon-Kamm et al., The Plant Cell, (1990) 2, 603-618) and rice (Shimamoto et al., Nature, (1989) 338, 274-276; Datta et al., Bio/Technology, (1990) 8, 736-740) and the method for transforming monocots generally (PCT publication WO 92/09696). For cotton transformation, the method described in PCT patent publication WO 00/71733 can be used. For soybean transformation, reference is made to methods known in the art, e.g., Hinchee et al. (Bio/Technology, (1988) 6, 915) and Christou et al. (Trends Biotech, (1990) 8, 145) or the method of WO 00/42207.

Genetically altered plants of the present invention can be used in a conventional plant breeding scheme to produce more genetically altered plants with the same characteristics, or to introduce the genetic alteration(s) in other varieties of the same or related plant species. Seeds, which are obtained from the altered plants, preferably contain the genetic alteration(s) as a stable insert in nuclear DNA or as modifications to an endogenous gene or promoter. Plants comprising the genetic alteration(s) in accordance with the invention include plants comprising, or derived from, root stocks of plants comprising the genetic alteration(s) of the invention, e.g., fruit trees or ornamental plants. Hence, any non-transgenic grafted plant parts inserted on a transformed plant or plant part are included in the invention.

Introduced genetic elements, whether in an expression vector or expression cassette, which result in the expression of an introduced gene, will typically utilize a plant-expressible promoter. A 'plant-expressible promoter' as used herein refers to a promoter that ensures expression of the genetic alteration(s) of the invention in a plant cell. Examples of promoters directing constitutive expression in plants are known in the art and include: the strong constitutive 35S promoters (the "35S promoters") of the cauliflower mosaic virus (CaMV), e.g., of isolates CM 1841 (Gardner et al., Nucleic Acids Res, (1981) 9, 2871-2887), CabbB S (Franck et al., Cell (1980) 21, 285-294; Kay et al., Science, (1987) 236, 4805) and CabbB JI (Hull and Howell, Virology, (1987) 86, 482-493); promoters from the ubiquitin family (e.g., the maize ubiquitin promoter of Christensen et al., Plant Mol Biol, (1992) 18, 675-689, or the *Arabidopsis* UBQ10 promoter of Norris et al. Plant Mol. Biol. (1993) 21, 895-906), the gos2 promoter (de Pater et al., The Plant J (1992) 2, 834-844), the emu promoter (Last et al., Theor Appl Genet, (1990) 81, 581-588), actin promoters such as the promoter described by An et al. (The Plant J, (1996) 10, 107), the rice actin promoter described by Zhang et al. (The Plant Cell, (1991) 3, 1155-1165); promoters of the Cassava vein mosaic virus (WO 97/48819, Verdaguer et al. (Plant Mol Biol, (1998) 37, 1055-1067), the pPLEX series of promoters from Subterranean Clover Stunt Virus (WO 96/06932, particularly the S4 or S7 promoter), an alcohol dehydrogenase promoter, e.g., pAdh1S (GenBank accession numbers X04049, X00581), and the TR1' promoter and the TR2' promoter (the "TR1' promoter" and "TR2' promoter", respectively) which drive the expression of the 1' and 2' genes, respectively, of the T DNA (Velten et al., EMBO J, (1984) 3, 2723 2730).

In preferred embodiments, plant-expressible promoters for achieving high levels of expression in cereal roots are used (described in Feike et al., Plant Biotechnology Journal (2019), 1-12, doi: 10.1111/pbi.13135). Non-limiting examples include pBdUBI10, pPvUBI2, pPvUBI1, pZmUBI, pOsPGD1, p35s, pOsUBI3, pBdEF1α, pAtUBI10, pOsAct1, pOsRS2, pZmEF1a, pZmTUB1a, pHvIDS2, ZmRsyn7, or pSiCCaMK (Feike et al., Plant Biotechnology Journal (2019), 1-12, doi: 10.1111/pbi.13135).

Alternatively, a plant-expressible promoter can be a tissue-specific promoter, i.e., a promoter directing a higher level of expression in some cells or tissues of the plant, e.g., in root cells. These plant promoters can be combined with enhancer elements, they can be combined with minimal promoter elements, or they can comprise repeated elements to ensure the expression profile desired.

In some embodiments, genetic elements to increase expression in plant cells can be utilized. For example, an intron at the 5' end or 3' end of an introduced gene, or in the coding sequence of the introduced gene, e.g., the hsp70 intron. Other such genetic elements can include, but are not limited to, promoter enhancer elements, duplicated or triplicated promoter regions, 5' leader sequences different from another transgene or different from an endogenous (plant host) gene leader sequence, 3' trailer sequences different from another transgene used in the same plant or different from an endogenous (plant host) trailer sequence.

An introduced gene of the present invention can be inserted in host cell DNA so that the inserted gene part is upstream (i.e., 5') of suitable 3' end transcription regulation signals (e.g., transcript formation and polyadenylation signals). This is preferably accomplished by inserting the gene in the plant cell genome (nuclear or chloroplast). Preferred polyadenylation and transcript formation signals include those of the nopaline synthase gene (Depicker et al., J. Molec Appl Gen, (1982) 1, 561-573), the octopine synthase gene (Gielen et al., EMBO J, (1984) 3:835 845), the SCSV or the Malic enzyme terminators (Schunmann et al., Plant Funct Biol, (2003) 30:453-460), and the T DNA gene 7 (Velten and Schell, Nucleic Acids Res, (1985) 13, 6981 6998), which act as 3' untranslated DNA sequences in transformed plant cells. In some embodiments, one or more of the introduced genes are stably integrated into the nuclear genome. Stable integration is present when the nucleic acid sequence remains integrated into the nuclear genome and continues to be expressed (e.g., detectable mRNA transcript or protein is produced) throughout subsequent plant generations. Stable integration into and/or editing of the nuclear genome can be accomplished by any known method in the art (e.g., microparticle bombardment, *Agrobacterium*-mediated transformation, CRISPR/Cas9, electroporation of protoplasts, microinjection, etc.).

The term recombinant or modified nucleic acids refers to polynucleotides which are made by the combination of two otherwise separated segments of sequence accomplished by the artificial manipulation of isolated segments of polynucleotides by genetic engineering techniques or by chemical synthesis. In so doing one may join together polynucleotide segments of desired functions to generate a desired combination of functions.

As used herein, the terms "overexpression" and "upregulation" refer to increased expression (e.g., of mRNA, polypeptides, etc.) relative to expression in a wild type organism (e.g., plant) as a result of genetic modification. In some embodiments, the increase in expression is a slight increase of about 10% more than expression in wild type. In some embodiments, the increase in expression is an increase of 50% or more (e.g., 60%, 70%, 80%, 100%, etc.) relative to expression in wild type. In some embodiments, an endogenous gene is overexpressed. In some embodiments, an exogenous gene is overexpressed by virtue of being expressed. Overexpression of a gene in plants can be achieved through any known method in the art, including but not limited to, the use of constitutive promoters, inducible promoters, high expression promoters, enhancers, transcriptional and/or translational regulatory sequences, codon optimization, modified transcription factors, and/or mutant or modified genes that control expression of the gene to be overexpressed.

Where a recombinant nucleic acid is intended for expression, cloning, or replication of a particular sequence, DNA constructs prepared for introduction into a host cell will typically comprise a replication system (e.g. vector) recognized by the host, including the intended DNA fragment encoding a desired polypeptide, and can also include transcription and translational initiation regulatory sequences operably linked to the polypeptide-encoding segment. Additionally, such constructs can include cellular localization signals (e.g., plasma membrane localization signals). In preferred embodiments, such DNA constructs are introduced into a host cell's genomic DNA, chloroplast DNA or mitochondrial DNA.

In some embodiments, a non-integrated expression system can be used to induce expression of one or more introduced genes. Expression systems (expression vectors) can include, for example, an origin of replication or autonomously replicating sequence (ARS) and expression control sequences, a promoter, an enhancer and necessary processing information sites, such as ribosome-binding sites, RNA splice sites, polyadenylation sites, transcriptional terminator sequences, and mRNA stabilizing sequences. Signal peptides can also be included where appropriate from secreted polypeptides of the same or related species, which allow the protein to cross and/or lodge in cell membranes, cell wall, or be secreted from the cell.

Selectable markers useful in practicing the methodologies of the invention disclosed herein can be positive selectable markers. Typically, positive selection refers to the case in which a genetically altered cell can survive in the presence of a toxic substance only if the recombinant polynucleotide of interest is present within the cell. Negative selectable markers and screenable markers are also well known in the art and are contemplated by the present invention. One of skill in the art will recognize that any relevant markers available can be utilized in practicing the inventions disclosed herein.

Screening and molecular analysis of recombinant strains of the present invention can be performed utilizing nucleic acid hybridization techniques. Hybridization procedures are useful for identifying polynucleotides, such as those modified using the techniques described herein, with sufficient homology to the subject regulatory sequences to be useful as taught herein. The particular hybridization techniques are not essential to the subject invention. As improvements are made in hybridization techniques, they can be readily applied by one of skill in the art. Hybridization probes can be labeled with any appropriate label known to those of skill in the art. Hybridization conditions and washing conditions, for example temperature and salt concentration, can be altered to change the stringency of the detection threshold. See, e.g., Sambrook et al. (1989) vide infra or Ausubel et al. (1995) Current Protocols in Molecular Biology, John Wiley & Sons, NY, N.Y., for further guidance on hybridization conditions.

Additionally, screening and molecular analysis of genetically altered strains, as well as creation of desired isolated nucleic acids can be performed using Polymerase Chain Reaction (PCR). PCR is a repetitive, enzymatic, primed synthesis of a nucleic acid sequence. This procedure is well known and commonly used by those skilled in this art (see Mullis, U.S. Pat. Nos. 4,683,195, 4,683,202, and 4,800,159; Saiki et al. (1985) Science 230:1350-1354). PCR is based on the enzymatic amplification of a DNA fragment of interest that is flanked by two oligonucleotide primers that hybridize to opposite strands of the target sequence. The primers are oriented with the 3' ends pointing towards each other. Repeated cycles of heat denaturation of the template, annealing of the primers to their complementary sequences, and extension of the annealed primers with a DNA polymerase result in the amplification of the segment defined by the 5' ends of the PCR primers. Because the extension product of each primer can serve as a template for the other primer, each cycle essentially doubles the amount of DNA template produced in the previous cycle. This results in the exponential accumulation of the specific target fragment, up to several million-fold in a few hours. By using a thermostable DNA polymerase such as the Taq polymerase, which is isolated from the thermophilic bacterium *Thermus aquaticus*, the amplification process can be completely automated. Other enzymes which can be used are known to those skilled in the art.

Nucleic acids and proteins of the present invention can also encompass homologues of the specifically disclosed sequences. Homology (e.g., sequence identity) can be 50%-100%. In some instances, such homology is greater than 80%, greater than 85%, greater than 90%, or greater than 95%. The degree of homology or identity needed for any intended use of the sequence(s) is readily identified by one of skill in the art. As used herein percent sequence identity of two nucleic acids is determined using an algorithm known in the art, such as that disclosed by Karlin and Altschul (1990) Proc. Natl. Acad. Sci. USA 87:2264-2268, modified as in Karlin and Altschul (1993) Proc. Natl. Acad. Sci. USA 90:5873-5877. Such an algorithm is incorporated into the BLASTN, BLASTP, and BLASTX, programs of Altschul et al. (1990) J. Mol. Biol. 215:402-410. BLAST nucleotide searches are performed with the BLASTN program, score=100, wordlength=12, to obtain nucleotide sequences with the desired percent sequence identity. To obtain gapped alignments for comparison purposes, Gapped BLAST is used as described in Altschul et al. (1997) Nucl. Acids. Res. 25:3389-3402. When utilizing BLAST and Gapped BLAST programs, the default parameters of the respective programs (BLASTN and BLASTX) are used. See www.ncbi.nih.gov. One of skill in the art can readily determine in a sequence of interest where a position corresponding to amino acid or nucleic acid in a reference sequence occurs by aligning the sequence of interest with the reference sequence using the suitable BLAST program with the default settings (e.g., for BLASTP: Gap opening penalty: 11, Gap extension penalty: 1, Expectation value: 10, Word size: 3, Max scores: 25, Max alignments: 15, and Matrix: blosum62; and for BLASTN: Gap opening penalty: 5, Gap extension penalty:2, Nucleic match: 1, Nucleic mismatch −3, Expectation value: 10, Word size: 11, Max scores: 25, and Max alignments: 15).

Preferred host cells are plant cells. Recombinant host cells, in the present context, are those which have been genetically modified to contain an isolated nucleic molecule, contain one or more deleted or otherwise non-functional genes normally present and functional in the host cell, or contain one or more genes to produce at least one recombinant protein. The nucleic acid(s) encoding the protein(s) of the present invention can be introduced by any means known to the art which is appropriate for the particular type of cell, including without limitation, transformation, lipofection, electroporation or any other methodology known by those skilled in the art.

"Isolated", "isolated DNA molecule" or an equivalent term or phrase is intended to mean that the DNA molecule or other moiety is one that is present alone or in combination with other compositions, but altered from or not within its natural environment. For example, nucleic acid elements such as a coding sequence, intron sequence, untranslated leader sequence, promoter sequence, transcriptional termination sequence, and the like, that are naturally found within the DNA of the genome of an organism are not considered to be "isolated" so long as the element is within the genome of the organism and at the location within the genome in which it is naturally found. However, each of these elements, and subparts of these elements, would be "isolated" from its natural setting within the scope of this disclosure so long as the element is not within the genome of the organism in which it is naturally found, the element is altered from its natural form, or the element is not at the location within the genome in which it is naturally found. Similarly, a nucleotide sequence encoding a protein or any naturally occurring variant of that protein would be an isolated nucleotide sequence so long as the nucleotide sequence was not within the DNA of the organism from which the sequence encoding the protein is naturally found in its natural location or if that nucleotide sequence was altered from its natural form. A synthetic nucleotide sequence encoding the amino acid sequence of the naturally occurring protein would be considered to be isolated for the purposes of this disclosure. For the purposes of this disclosure, any transgenic nucleotide sequence, i.e., the nucleotide sequence of the DNA inserted into the genome of the cells of a plant, alga, fungus, or bacterium, or present in an extrachromosomal vector, would be considered to be an isolated nucleotide sequence whether it is present within the plasmid or similar structure used to transform the cells, within the genome of the plant or bacterium, or present in detectable amounts in tissues, progeny, biological samples or commodity products derived from the plant or bacterium.

Having generally described this invention, the same will be better understood by reference to certain specific examples, which are included herein to further illustrate the invention and are not intended to limit the scope of the invention as defined by the claims.

EXAMPLES

The present disclosure is described in further detail in the following examples which are not in any way intended to limit the scope of the disclosure as claimed. The attached figures are meant to be considered as integral parts of the specification and description of the disclosure. The following examples are offered to illustrate, but not to limit the claimed disclosure.

Example 1: Oligosaccharides and Nutrient Levels Contribute to Symbiosis and Immunity Signaling in Legumes The following example describes experiments measuring activation of symbiosis signaling and immunity signaling in *Medicago truncatula* in response to oligosaccharide perception and nutrient levels.

Materials and Methods

Plant Materials and Growth Conditions

The wild type *M. truncatula* cv. Jemalong A17 background was used. Seedlings were grown on modified Buffered Nodulation Media (BNM) with 100 nM Aminoethoxyvinylglycine (AVG; Sigma-Aldrich) for five days under different nutrient conditions. Nitrogen and phosphorus levels were manipulated by altering the concentrations of potassium nitrate ($KNO_3$) and potassium dihydrogen phosphate ($KH_2PO_4$) in the media. For the replete nitrate and replete phosphate (+N+P) condition, BNM was modified with 5 mM $KNO_3$ and 3.75 mM $KH_2PO_4$. For the limiting nitrate and replete phosphate (i.e., no nitrate and replete phosphate, −N+P) condition, BNM was modified with 3.75 mM $KH_2PO_4$. For the replete nitrate and limiting phosphate (+N−P) condition, BNM was modified with 0.0075 mM $KH_2PO_4$ and 5 mM $KNO_3$. For the limiting nitrate and limiting phosphate (i.e., no nitrate and low phosphorus, −N−P) condition, BNM was modified with 0.0075 mM $KH_2PO_4$. The high phosphate concentration used for replete phosphate conditions was based on concentrations previously shown to suppress mycorrhization in *M. truncatula* (Balzergue, C. et al. *Frontiers in plant science* 4: article 426).

Nuclear Calcium Imaging

Figure 1A:
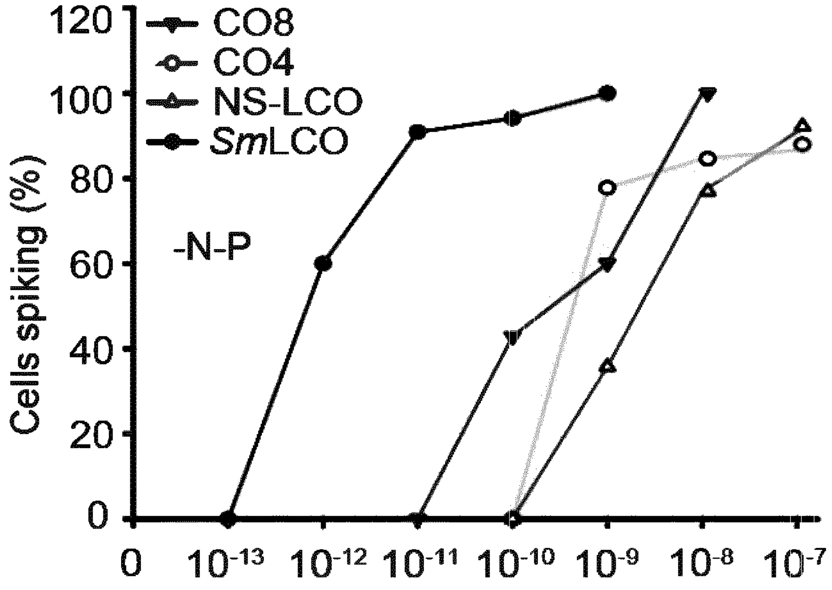
FIGS. 1A-1B provide the proportion of *Medicago truncatula* root epidermal cells that undergo nuclear calcium oscillations in response to treatment with chitooligosaccharides (COs) or lipochitooligosaccharides (LCOs).
Figure 1B:
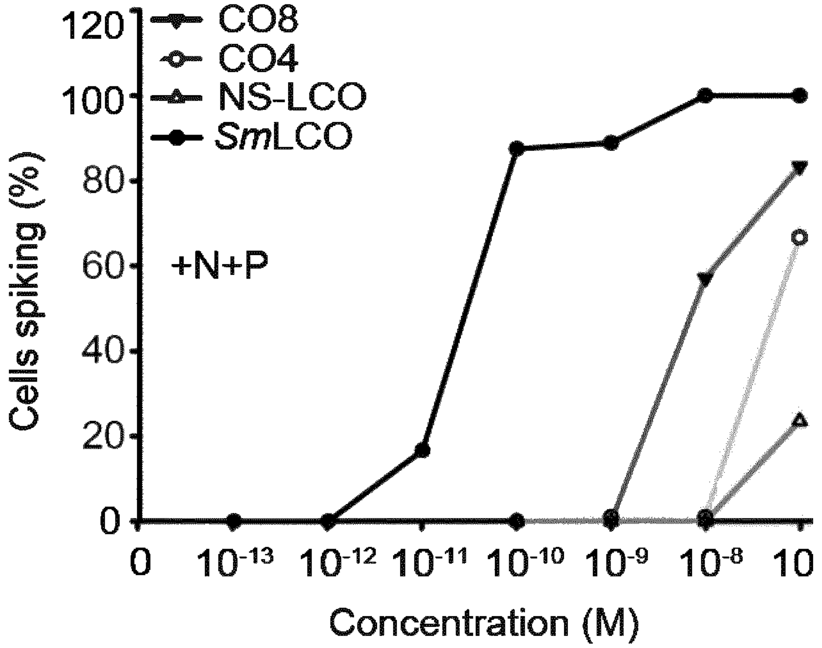

For calcium analyses *M. truncatula* seedlings were grown on Buffered Nodulation Media (BNM) agar with 100 nM Aminoethoxyvinylglycine (AVG; Sigma-Aldrich) until lateral roots emerged (FIGS. 1A-1B). All calcium analyses in *M. truncatula* were performed on lateral roots, since these have been demonstrated to show greater sensitivity to symbiotic signals than the primary root (Limpens, E. et al. *Science* 302: 630-633). The lateral roots were fixed in a small chamber made on a cover glass using vacuum grease, with 500 μl of BNM buffer. The roots were then treated with COs (CO4 or CO8), LCOs (non-sulfated LCO (NS-LCO) or a LCO derived from *Sinorhizobium meliloti* (SmLCO)), at the concentrations indicated in FIGS. 1A-1B. Recordings were collected on an inverted epifluorescence microscope (model TE2000; Nikon). Yellow cameleon YC3.6 was excited with an 458-nm laser and imaged using emission filters 476-486 nm for CFP and 529-540 nm for YFP. The calcium images were collected every 5 seconds with 1 second exposure and analyzed using Metafluor (Molecular Devices). Calcium traces used the intensity ratio of YFP to CFP. For better visualization of calcium signals, the traces were flattened to a single axis by subtracting the values with moving average as the following formula:

$$S_f = S_o - MA$$

Where $S_f$ is the flattened signal, $S_o$ is the original signal, and MA is the moving average of the value. For each element i, MA is calculated as:

$$MA = \begin{cases} \sum_{j=1-w}^{i+w} \frac{x_j}{m} & \text{if } i > w \\ \sum_{j=1}^{i+w} \frac{x_j}{(W+i)} & \text{else} \end{cases}$$

where m is the arbitrary number of points to calculate the average, w=[m/2] and $x_j$ is the signal at point j.

*M. truncatula* Gene Expression

Figure 2A:
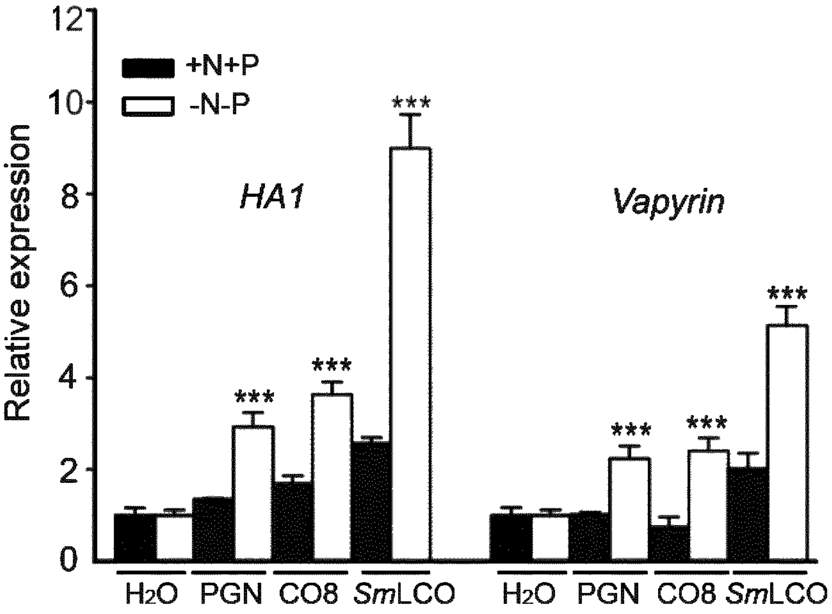
FIGS. 2A-2B provide the relative expression of *M. truncatula* genes in response to treatment with COs, LCOs, and other molecules under different nutrient conditions.
Figure 2B:
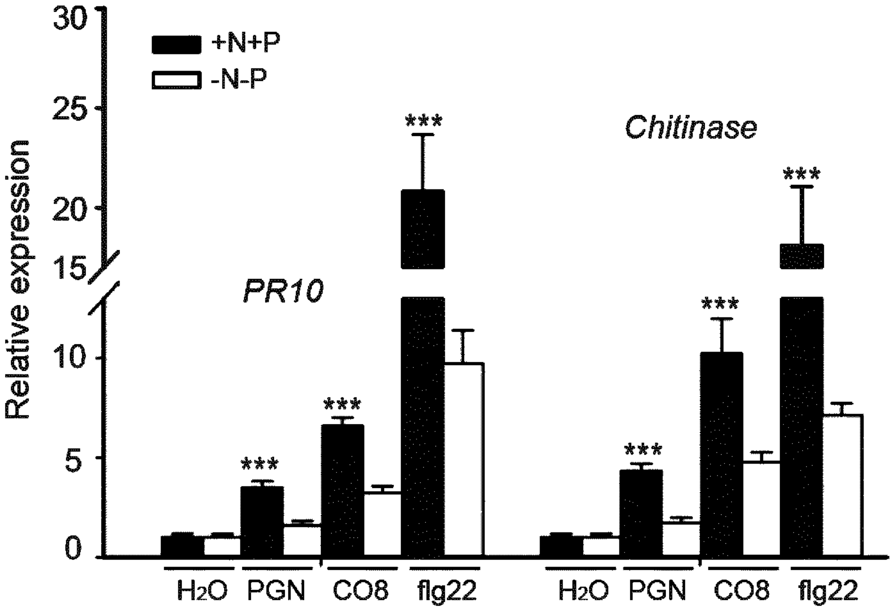

Gene expression was measured by qRT-PCR (FIGS. 2A-2B). Plants were grown on modified BNM plates (described above) with 100 nM AVG for four days, the plants were then carefully transferred to liquid BNM with the appropriate nutrient concentrations along with COs, PGN, flg22 and SmLCO, at a final concentration of $10^{-7}$ M COs, $10^{-7}$ M flg22, 0.4 mg/ml PGN and $10^{-8}$ M SmLCO. After incubation for 6 h, plant roots were harvested and frozen in liquid nitrogen. Total RNA was extracted from root tissues using the Qiagen R Neasy Plant mini kit, DNA was removed by treatment of RNA with RNase-free DNase according to the manufacturer's instructions. An aliquot of each total RNA sample was used to determine RNA concentration and purity assessed on the NanoDrop ND-1000 spectral photometer (Peglab, Erlangen, Germany). RNA integrity was analyzed on the 2100 Bioanalyzer using RNA 6000 Nano LabChip Kits (Agilent Technologies). One microgram of total RNA was used for cDNA synthesis with an iScript™ cDNA Synthesis Kit (Bio-Rad). Gene expression was determined by an ABI 7500 using a SYBR green PCR master mix (Bio-Rad). The Vapyrin (Medtr6g027840) and HA1 (Medtr8g006790) genes were used as symbiosis marker genes while pathogenesis-related proteins PR10 (Medtr4g120940) and a plant chitinase (Medtr2g099470) were considered as defense marker genes (all were induced by flg22). Expression data were analyzed from the average of threshold cycle (CT) value, using an *M. truncatula* endogenous Histone 2A (H2A) gene as reference and fold induction calculated for treatment of elicitors relative to treatment with DMSO. The qRT-PCR primers used can be found in Table 1.

TABLE 1

M. truncatula qPCR primer sequences and *Phytophthora palmivora* EF1a qPCR primer sequences

| Primer Name | Sequence, 5' to 3' | Use |
|---|---|---|
| LYK10-F<br>LYK10-R | AGAAGCTACGAGCCAAGGTAGC (SEQ ID NO: 1)<br>AGGTAGCCTGGTGTTCCAACAAG (SEQ ID NO: 2) | LYK10 qPCR |
| PR10-F<br>PR10-R | GGCTCAAATGGAGGGTCTATTG (SEQ ID NO: 3)<br>GCTTTGCCTTCCTCAACCT (SEQ ID NO: 4) | PR10 qPCR |
| Chitinase-F<br>Chitinase-R | GGCTGACATCCTTACACAAGA (SEQ ID NO: 5)<br>AGAATTGAGGGCATCGAGAAA (SEQ ID NO: 6) | Chitinase qPCR |
| HA1-F<br>HA1-R | CCATGATAGCGCAGAAACAATC (SEQ ID NO: 7)<br>CCTTCCCGTTTCCTTTCCTATT (SEQ ID NO: 8) | HA1 qPCR |
| Vapyrin-F<br>Vapyrin-R | GCCAGTTGCATTTAGGATTCA (SEQ ID NO: 9)<br>GCACCTGGAGCAAGAACACT (SEQ ID NO: 10) | Vapyrin qPCR |
| Histone 2A-F<br>Histone 2A-R | CTTTGCTTGGTGCTGTTTAGATGG (SEQ ID NO: 11)<br>ATTCCAAAGGCGGCTGCATA (SEQ ID NO: 12) | Histone 2A qPCR |
| D27-F<br>D27-R | AGTTCTTGCAAGGCCTACAGATG (SEQ ID NO: 13)<br>TGATTCCTGTTGCTGCTTGAACAC (SEQ ID NO: 14) | D27 qPCR |
| PpEF1a-F<br>PpEF1a-R | CAAGATCCCGTTCGTGCCTA (SEQ ID NO: 15)<br>GCGTTCAGGTTGTCAAGAGC (SEQ ID NO: 16) | *Phytophthora palmivora* EF1a qPCR |

Detection of Reactive Oxygen Species

Figure 3:
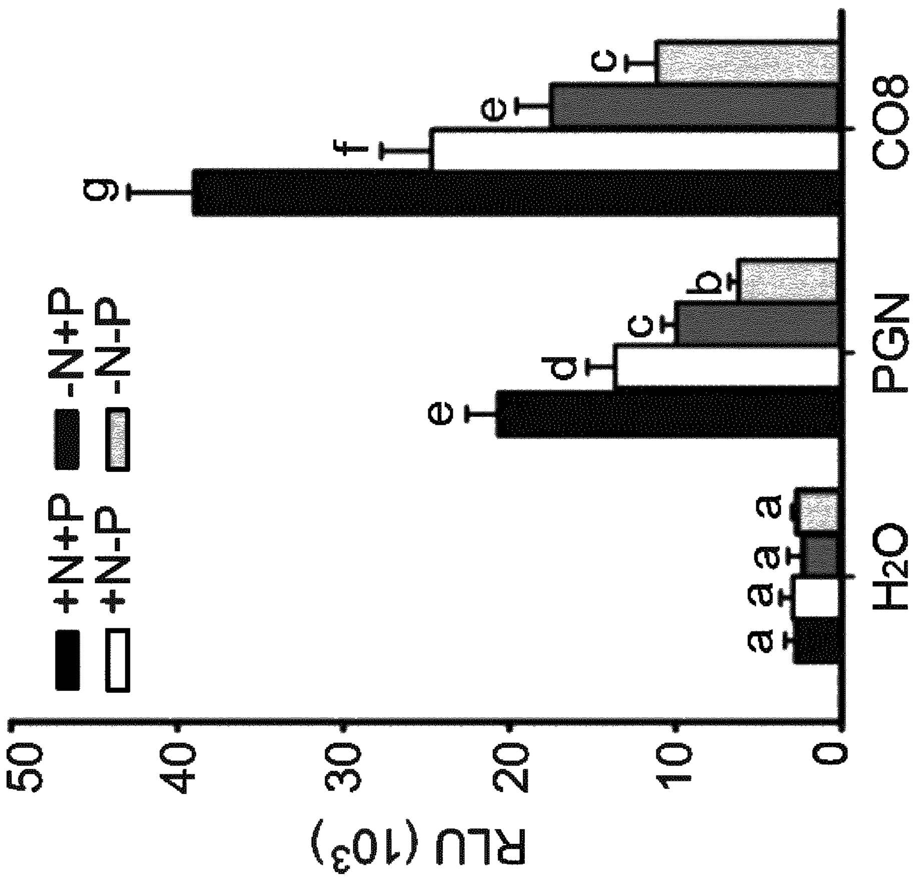
FIG. 3 provides the level of reactive oxygen species (ROS) production by *M. truncatula* in response to treatment with CO8 or peptidoglycan under different nutrient conditions. As indicated on the x-axis, plants were treated with either water ($H_2O$), peptidoglycan (PGN), or CO8. The y-axis indicates mean relative light units (RLU ($10^3$)) of the reactive oxygen species assay, ±s.e.m. Reactive oxygen species formation was measured under conditions with replete nitrate and phosphate (+N+P, 5 mM $NO_3^-$ and 3.75 mM $PO_4^-$, black bars), limiting nitrate and replete phosphate (−N+P, 0 mM $NO_3^-$ and 3.75 mM $PO_4^-$, dark gray bars), replete nitrate and limiting phosphate (+N−P, 5 mM $NO_3^-$ and 0.0075 mM $PO_4^-$ white bars), or limiting nitrate and limiting phosphate (−N−P, 0 mM $NO_3^-$ and 0.0075 mM $PO_4^-$ light gray bars). Letter labels above each bar denote statistically significant groupings calculated by a Mann-Whitney Rank Sum Test, with a sample size of n=6, and P<0.05.

*M. truncatula* primary roots growing on different nutrient conditions for 5 days were cut into 0.5 cm strips and incubated in 200 μL liquid medium containing different nutrient conditions in a 96-well plate (Greiner Bio-one) overnight. After incubation, the water was removed from each well and exchanged with 200 μL reaction buffer containing 0.5 mM L-012 (Wako Chemicals, USA) according to experiments performed. The fungal germinated spores exudates (GSE, 10 times concentrated) were used to detect ROS production in *M. truncatula* roots. Luminescence was recorded with a Varioskan™ Flash Multimode Reader (Thermo Fisher Scientific) (FIG. 3).

Impact of Nutrients on Nodulation

*M. truncatula* wild type seedlings were grown on either high nitrate and high phosphate medium (+N+P, BNM modified with 5 mM $KNO_3$ and 3.75 mM $KH_2PO_4$) or no nitrogen and low phosphorus medium (−N−P, BNM modified with 0.0075 mM $KH_2PO_4$). Plants for nodulation were transferred to a 1:1 mix of sand: terragreen (Oil-Dri Company, Wisbech, UK) and *S. meliloti* 1021 was inoculated by watering on plant roots with $OD_{600}$=0.02. Nodules were counted at 1 week, 2 weeks, and 3 weeks post inoculation using a Leica M205FA stereo microscope.

Mycorrhizal Colonization Assays

*M. truncatula* plants were grown in pots (4×4×4.5 $cm^3$) containing aluminum silicate/sand and inoculated with 200 spores of *Rhizophagus irregularis* produced by Premier Tech (Quebec, Canada). Mycorrhizal colonized roots were collected and incubated in 10% KOH (Sigma-Aldrich) at 95° C. for 10 minute and then stained with 5% ink (Waterman) in acetic acid (Sigma-Aldrich) at 5 weeks (Giovanetti M., et al. *New Phytol.* 84: 489-500). The grid line intersect method (Giovanetti M., et al. *New Phytol.* 84: 489-500) was used to quantify mycorrhizal colonization: roots were cut into 1 cm segments and spread randomly in plastic petri dishes in which a grid with 1 cm×1 cm squares was affixed to the base. 120 intersections for each root sample were counted to measure roots with or without mycorrhizal infection on a Leica DM6000 light microscope.

*Phytophthora palmivora* Infection Assays

Figure 5B:
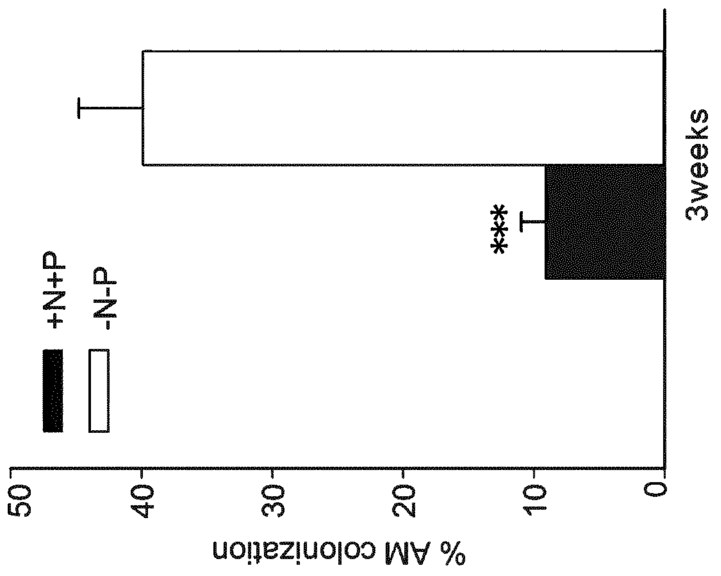
FIGS. 5A-5D show the effect of nutrient levels on various forms of microbial colonization in *M. truncatula*.
Figure 5A:
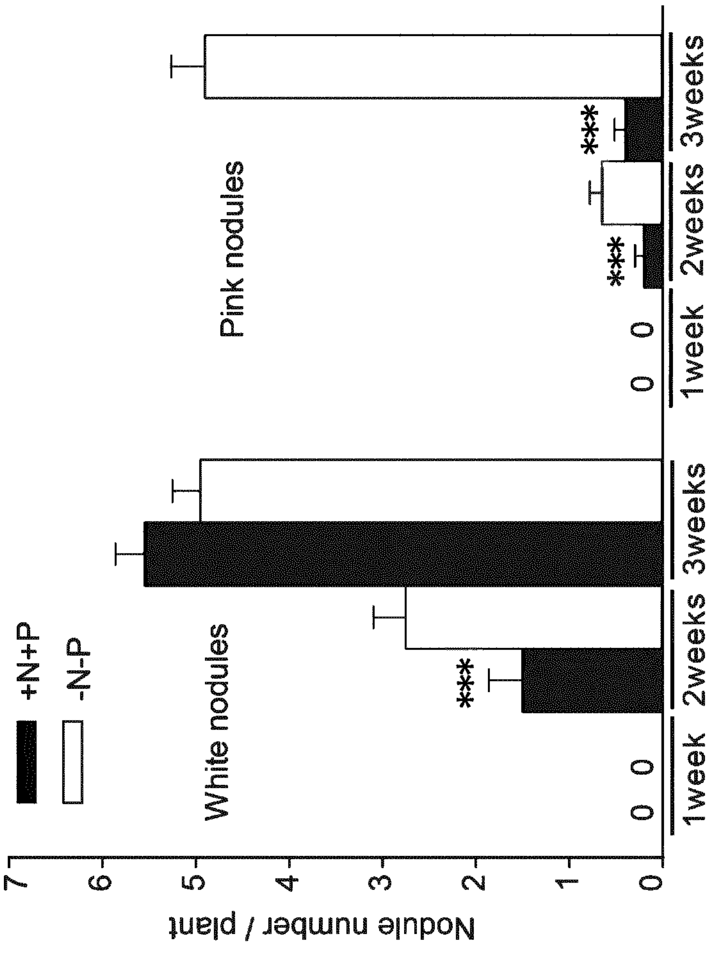
Figure 5C:
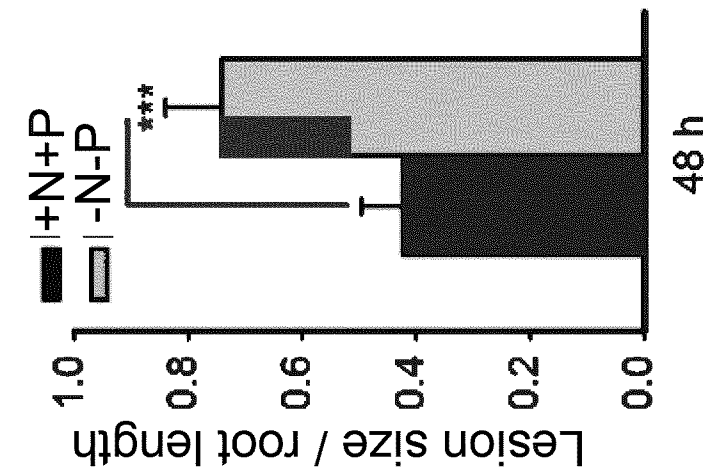
Figure 5D:
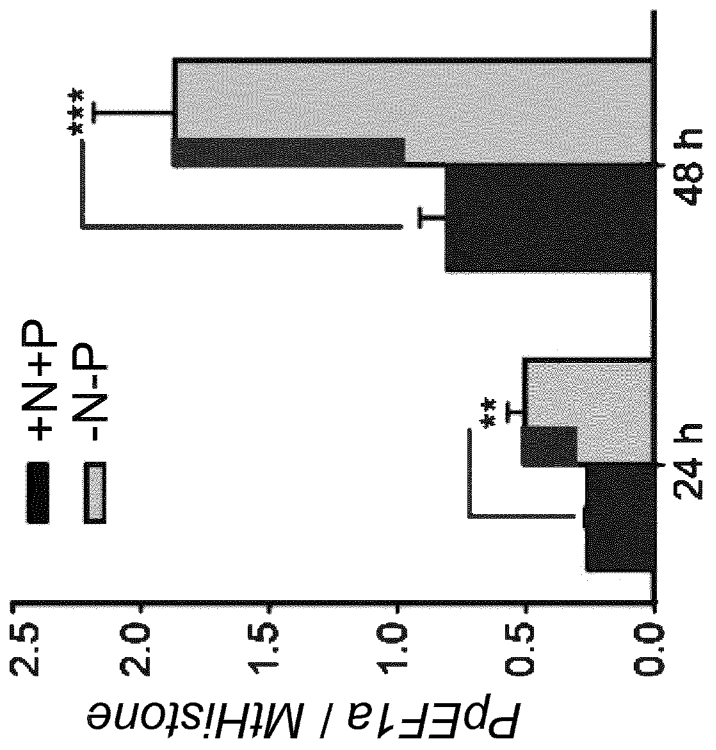

*Phytophthora palmivora* was grown on V8 juice agar medium for 7 days until mycelium were fully expanded over the whole plate. The plates were then kept in a fume hood for 24 h, to dry the medium. 10 ml sterilized cool water was poured on each plate and kept for 1 h to release zoospores. The concentration of spores was quantified on a hemacytometer. *M. truncatula* seedlings were grown on +N+P (5 mM $KNO_3$ and 3.75 mM $KH_2PO_4$) and −N−P (0.0075 mM $KH_2PO_4$) plates for 1-3 days and root tip regions were inoculated with $1\times10^5$/ml *P. palmivora* spores. To quantify *P. palmivora* growth, 30 seedlings for each ecotype 48 h post-inoculation were used to measure the lesion size and this was normalized to the individual root length (FIG. 5C). Uncolonized roots were not included in the analysis. The same root samples were then frozen in liquid nitrogen to extract RNA for qRT-PCR analysis. Expression data were analyzed from the average of threshold cycle (CT) value, using *P. palmivora* EF1a gene relative to the *M. truncatula* $H_2A$ housekeeping gene (FIG. 5D). The qRT-PCR primers used can be found in Table 1.

Results

The effects of oligosaccharides on *M. truncatula* colonization by symbiotic mycorrhizal fungi was examined. Oscillations in nuclear-associated calcium levels in root epidermal cells have been shown to be a component of *M. truncatula* symbiotic signaling. The COs CO4 and CO8, as well as the LCOs NS-LCO and SmLCO, were tested for their ability to promote nuclear calcium oscillations in *M. truncatula* root epidermal cells under different nutrient conditions. As shown in FIGS. 1A-1B, all four oligosaccharides promoted nuclear symbiotic oscillations ("Cells spiking"). SmLCO promoted symbiotic calcium oscillations at the lowest concentration of oligosaccharide (FIGS. 1A-1B). The proportion of cells undergoing symbiotic calcium oscillations was elevated under conditions with limiting nitrate and phosphate (FIG. 1A), relative to conditions replete with nitrate and phosphate (FIG. 1B).

As shown in FIG. 2A, *M. truncatula* genes associated with symbiosis signaling had increased expression under nutrient limiting conditions, and decreased expression under nutrient replete conditions when plants were treated with oligosaccharides. In contrast, *M. truncatula* genes associated with immunity signaling had decreased expression under nutrient limiting conditions, and increased expression under nutrient replete conditions (FIG. 2B). The relative activation of *M truncatula* genes associated with both symbiosis and immunity therefore showed a nutrient dependence. Similarly, the production of reactive oxygen species associated with immunity signaling also showed a nutrient dependence (FIG. 3).

Lipochitooligosaccharides (LCO) and chitooligosaccharide (CO) perception has been shown to be essential for mycorrhizal colonization in *M. truncatula* (Feng et al. *Nature* Comms 2019 10: 5047). The CO receptor complex has been shown to either promote or restrict fungal colonization (Bozsoki et al. *Proc. Natl. Acad. Sci.* 2017 10.1073/pnas.1706795114; Feng et al. *Nature* Comms 2019 10:5047), highlighting the need for additional decision points that dictate the outcome of fungal recognition through the perception of COs. Taken together, these results indicate that this additional decision was defined by the prior nutrient status of the plant: symbiosis signaling was enhanced by nutrient starvation, whereas immunity signaling was suppressed (FIGS. 2A-2B, FIG. 3). To further investigate this, the effect of nutrient levels on various forms of microbial colonization in *M. truncatula* was tested. As shown in FIGS. 5A-5D, both symbiotic and pathogenic microorganisms preferentially colonized the *M. truncatula* root under nutrient starvation conditions.

Figure 4:
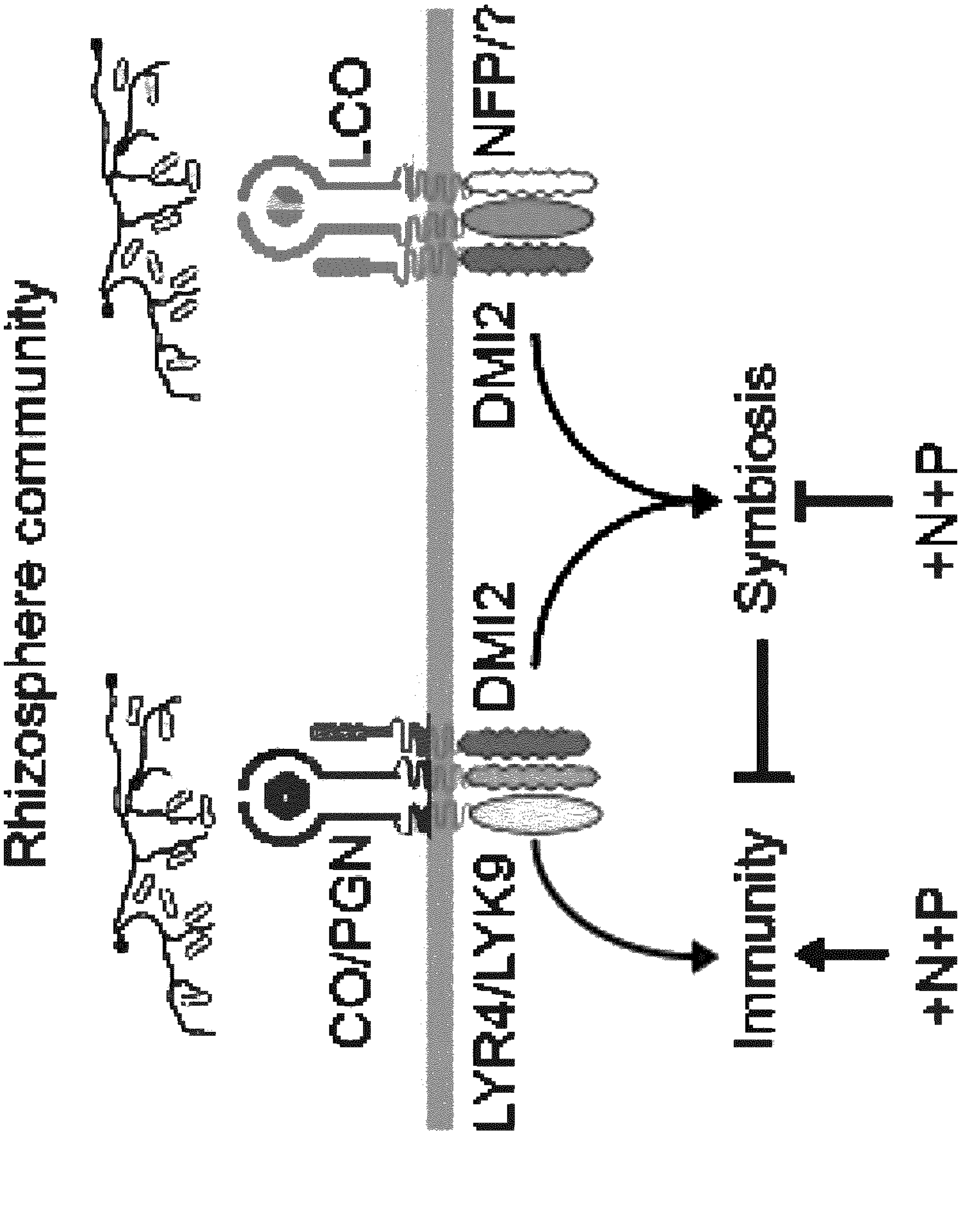
FIG. 4 provides a schematic summary of receptor perception of COs and LCOs in *M. truncatula*, showing the integration of CO perception and LCO perception (at plant cell surface, shown as grey bars) as well as the impact of high nutrient conditions on immunity-related or symbiosis-related signaling. CO perception is shown on left, with fungal-derived or bacterial-derived CO/PGN (grey hexagon with black star) being perceived by the extracellular portion of the plant receptors LYR4/LYK9 (intracellular light grey oval and extracellular hook; intracellular grey wavy shape and extracellular hook) and DMI2 (intracellular dark grey wavy shape and extracellular black rod with grey dots), and the intracellular portion of the plant receptors promoting either immunity-related or symbiosis-related signaling. LCO perception is shown on right, with rhizobial or mycorrhizal LCO (light grey circle) being perceived by the extracellular portion of the plant receptors NFP/? (intracellular dark grey oval and extracellular hook; intracellular light grey wavy shape and extracellular hook) and DMI2 (intracellular dark grey wavy shape and extracellular black rod with grey dots), and the intracellular portion of the plant receptors promoting symbiosis-related signaling. As shown in the schematic summary, conditions replete with nitrogen (e.g., nitrate, ammonium, or amino acids) and phosphate promote immunity-related signaling and repress symbiosis-related signaling.

FIG. 4 shows a model of plant perception of COs and LCOs, the signaling as a result of CO and LCO perception that promotes immunity and symbiosis signaling responses, and the contribution of nutrient levels to those signaling responses. Without wishing to be bound by theory, it is thought that the surface of fungi and bacteria are recognized by plant receptor complexes able to perceive fungal-derived COs and bacterial-derived PGNs (shown on left in FIG. 4), while symbiotic microorganisms are perceived by detecting LCOs (shown on right in FIG. 4) produced by arbuscular mycorrhizal fungi and by nitrogen-fixing rhizobial bacteria. Perception of COs or PGN indicates the proximity of a microorganism, but does not allow the plant to differentiate a pathogen from a symbiont, since both symbionts and pathogens possess COs or PGN on their surface. Consistently, the perception of COs/PGN is able to activate both symbiosis and immunity signaling. Perception of LCOs, produced by beneficial microorganisms, only activates symbiosis signaling. Further, without wishing to be bound by theory, when plants are grown under replete nitrate and phosphate (+N+P), symbiosis signaling is repressed, as the plants are able to obtain nutrients without colonization by microorganisms. Replete nitrate and phosphate promote immunity signaling to prevent colonization by pathogenic microorganisms (FIG. 4). In contrast, when the plant is grown under limiting nitrate and phosphate (−N−P) symbiosis signaling is promoted, as colonization by microorganisms will allow plants to obtain nutrients from the environment (i.e., microorganisms are able to take up nutrients present in forms that are inaccessible to plants, and then provide the nutrients to the plant). This promotion of symbiosis signaling correlates with the repression of immunity signaling, thus making the plant more susceptible to invasion by all microorganisms, including pathogens. Symbiosis signaling has been demonstrated to further suppress immunity signaling.

Example 2. Oligosaccharides and Nutrient Levels Contribute to Symbiosis and Immunity Signaling in Monocots The following example describes the symbiotic relationship between monocots and mycorrhizal fungi. In particular, the following example describes the contributions of oligosaccharide perception and nutrient levels to *Hordeum vulgare* (barley) and *Zea mays* (maize) symbioses with mycorrhizal fungi, and/or immunity-related signaling.

Materials and Methods

Plant Materials and Growth Conditions

The wild type *Z. mays* W22 background was used.

*Hordeum vulgare* cv. Golden Promise was transformed as previously described (Bartlett et al. *Plant Biotechnol. J.* 2008 7:856-866). Leaf tissue (1-2 cm leaf material) from individual hygromycin-resistant transgenic barley plants was frozen in liquid nitrogen.

Figure 8:
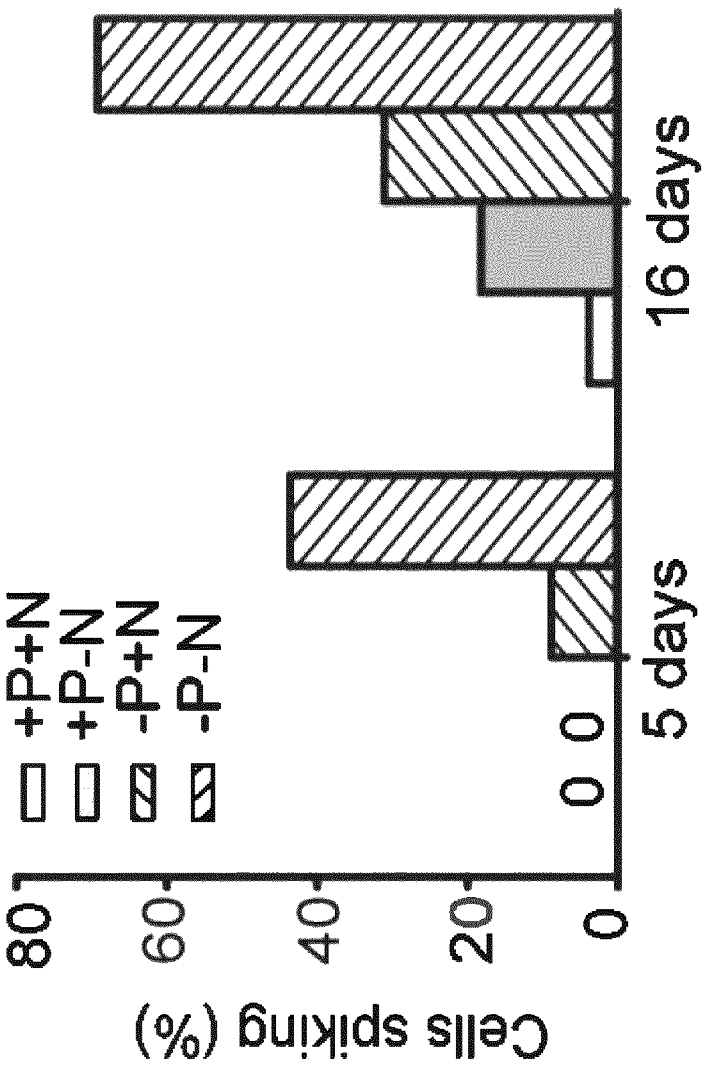
FIG. 8 provides the proportion of *H. vulgare* root epidermal cells that undergo nuclear calcium oscillations when grown under different nutrient conditions. *H. vulgare* was grown with replete phosphate and nitrate (+P+N, 0.5 mM $PO_4^-$ and 5 mM $NO_3^-$, white bars), replete phosphate and limiting nitrate (+P−N, 0.5 mM $PO_4^-$ and 0 mM $NO_3^-$, solid gray bars), limiting phosphate and replete nitrate (−P+N, 0 mM $PO_4^-$ and 5 mM $NO_3^-$, white bars with left-slanted stripes), or limiting phosphate and nitrate (−P−N, 0 mM $PO_4^-$ and 0 mM $NO_3^-$, white bars with right-slanted stripes). The x-axis indicates the number of days of growth, and the y-axis indicates the percentage of cells that responded to $10^{-7}$ M SmLCO treatment with nuclear-associated calcium oscillations ("Cells spiking").

*H. vulgare* plants tested in FIG. 8 were grown on BNM media containing either replete phosphate and nitrate (+P+N, 0.5 mM $PO_4^-$ and 5 mM $NO_3^-$), replete phosphate and limiting nitrate (+P−N, 0.5 mM $PO_4^-$ and 0 mM $NO_3^-$), limiting phosphate and replete nitrate (−P+N, 0 mM $PO_4^-$ and 5 mM $NO_3^-$), or limiting phosphate and nitrate (−P−N, 0 mM $PO_4^-$ and 0 mM $NO_3^-$) for either 5 or 16 days, as indicated. As described in Example 1, nitrogen and phosphorus levels were manipulated by altering the concentrations of potassium nitrate ($KNO_3$) and potassium dihydrogen phosphate ($KH_2PO_4$) in the media. Roots were removed and transferred to liquid media for calcium imaging. *H. vulgare* plants tested in FIG. 9 were grown on BNM media containing either replete nitrate and phosphate (+N+P, 5 mM $NO_3^-$ and 0.5 mM $PO_4^-$), limiting nitrate and replete phosphate (−N+P, 0 mM $NO_3^-$ and 0.5 mM $PO_4^-$), replete nitrate and limiting phosphate (+N−P, 5 mM $NO_3^-$ and 0 mM $PO_4^-$), or limiting nitrate and limiting phosphate (−N−P, 0 mM $NO_3^-$ and 0 mM $PO_4^-$).

*H. vulgare* plants were grown with high nitrate (HN; 3 mM $NO_3^-$) concentration in combination with a range of phosphate concentrations, including 10 μM phosphate, 500 μM phosphate, 1 mM phosphate, or 2.5 mM (FIG. 10A). *H. vulgare* plants were also grown with low nitrate (HN; 0.5 mM $NO_3^-$) concentration in combination with a range of phosphate concentrations, including 10 μM phosphate, 500 μM phosphate, 1 mM phosphate, or 2.5 mM phosphate (FIG. 10B). Further, *H. vulgare* plants were grown with 10 μM phosphate, 100 μM phosphate, 250 μM phosphate, 500 μM phosphate (FIG. 10C). In these experiments, the plants were fed with one-half strength Hoagland solution with added nitrate or phosphate.

Mycorrhizal Colonization Assays

Mycorrhizal colonization of *H. vulgare* with *R. irregularis* was measured 5 weeks or 7 weeks post inoculation. Mycorrhizal colonization of *Z. mays* with *R. irregularis* was measured 7 weeks post inoculation. Fungal colonization was quantified by tryptan blue staining. Samples of root pieces of approximately 1 cm in size were incubated in 10% KOH for 30 min at 96° C. followed by three washes with distilled water. Afterwards, the samples were incubated in 0.3 M HCl for 30-120 minutes at room temperature. The samples were boiled at 96° C. for 8 minutes in a 0.1% w/v tryptan blue staining solution in a 2:1:1 mixture of lactic acid:glycerol: distilled water before they were de-stained with a 1:1 solution of glycerol and 0.3 M HCl. 10 root pieces per sample were mounted on a cover slide, and total fungal colonization as well as the presence of specific fungal structures was quantified at 10 representative random points per root piece microscopically. All fungal structures present at one random point were recorded.

Nuclear Calcium Imaging

Figure 7:
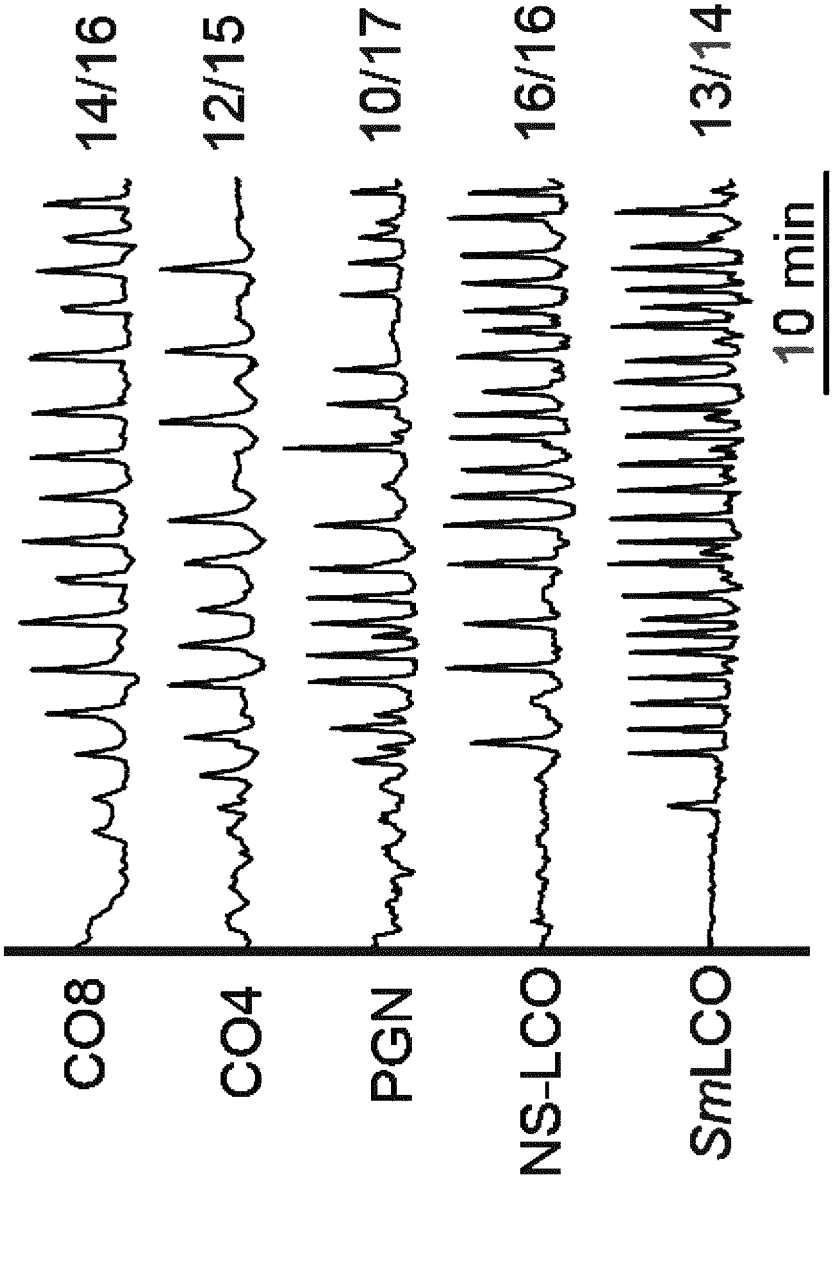
FIG. 7 provides traces of nuclear calcium oscillations produced by *H. vulgare* root epidermal cells in response to treatment with the molecules indicated. From top to bottom, *H. vulgare* root cells were treated with CO8, CO4, peptidoglycan (PGN), non-sulfated LCO (NS-LCO), or LCO derived from *S. meliloti* (SmLCO). The scale bar indicates a span of 10 minutes, and the fractions to the right of the traces indicate the number of cells that responded over the total number of cells analyzed.

For *H. vulgare* calcium analyses, plants were grown on the relevant nutrient medium (see Plant materials and growth conditions above) for 5 or 16 days (FIG. 8). As shown in FIG. 7, plants were treated with $10^{-7}$ M of either CO4, CO8, NS-LCO, or SmLCO, or 0.4 mg/ml of PGN. Calcium recordings were collected on an inverted epifluorescence microscope (model TE2000; Nikon) and data were analyzed as described previously (Sun, J. et al. *Plant Cell* 27: 823-838).

Detection of Reactive Oxygen Species

*H. vulgare* roots were grown on different nutrient conditions for 5 days, and then cut into 0.5 cm strips and incubated in 200 µL liquid medium containing different nutrients in a 96-well plate (Greiner Bio-one) overnight. After incubation, the medium was removed from each well and exchanged with 200 µL reaction buffer containing 0.5 mM L-012 (Wako Chemicals, USA). Luminescence was recorded with a Varioskan™ Flash Multimode Reader (Thermo Fisher Scientific).

Results

Figure 6A:
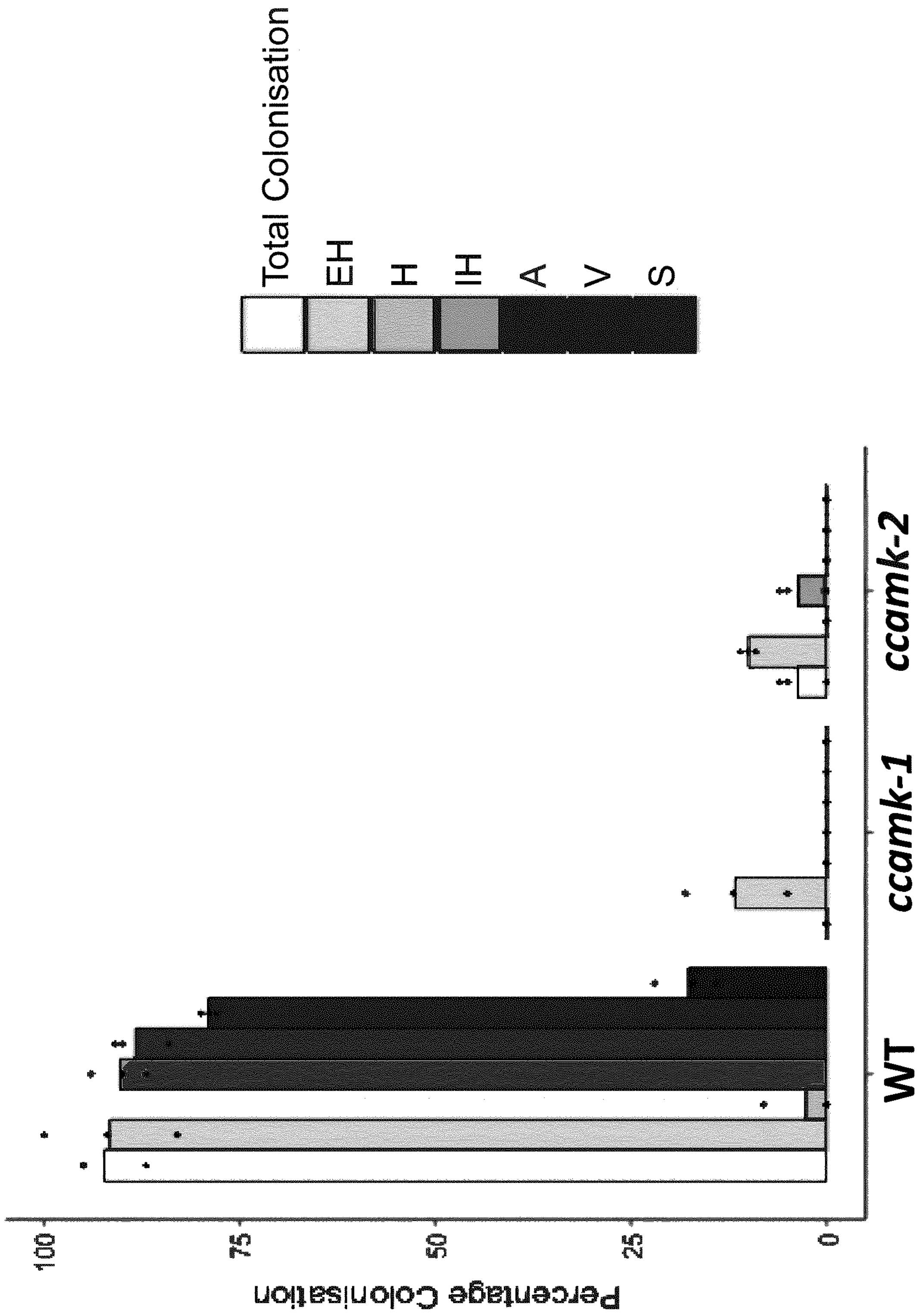
FIGS. 6A-6C provide the level of mycorrhizal colonization of *Zea mays* (maize, FIG. 6A) and *Hordeum vulgare* (barley, FIGS. 6B-6C) plants of different genotypes by *R. irregularis*.
Figure 6B:
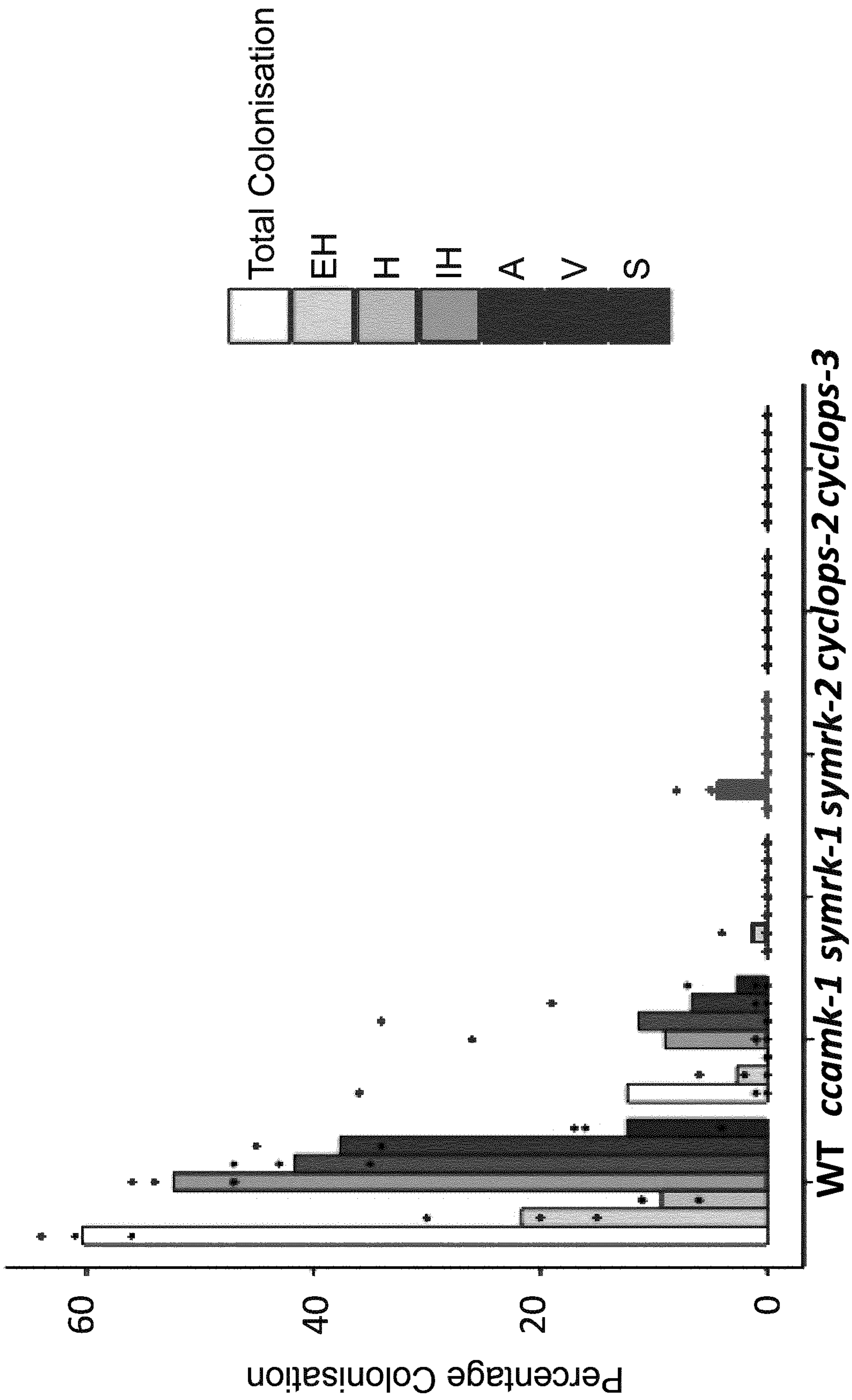

The level of mycorrhizal colonization of monocot plants of different genotypes was tested (FIGS. 6A-6B). While wild type *Z. mays* roots were colonized by mycorrhizal fungi at a relatively high level, *Z. mays* roots mutant in the Sym signaling pathway gene CCaMK were not (FIG. 6A). In addition, mycorrhizal colonization of various *H. vulgare* mutants was tested (FIG. 6B). As in maize, wild type *H. vulgare* was colonized at a relatively high level, while plants mutant in either CCaMK, SYMRK or CYCLOPs were not. These results showed that components of the Sym signaling pathway were therefore required for mycorrhizal colonization of the roots of both *Z. mays* and *H. vulgare*.

Figure 6C:
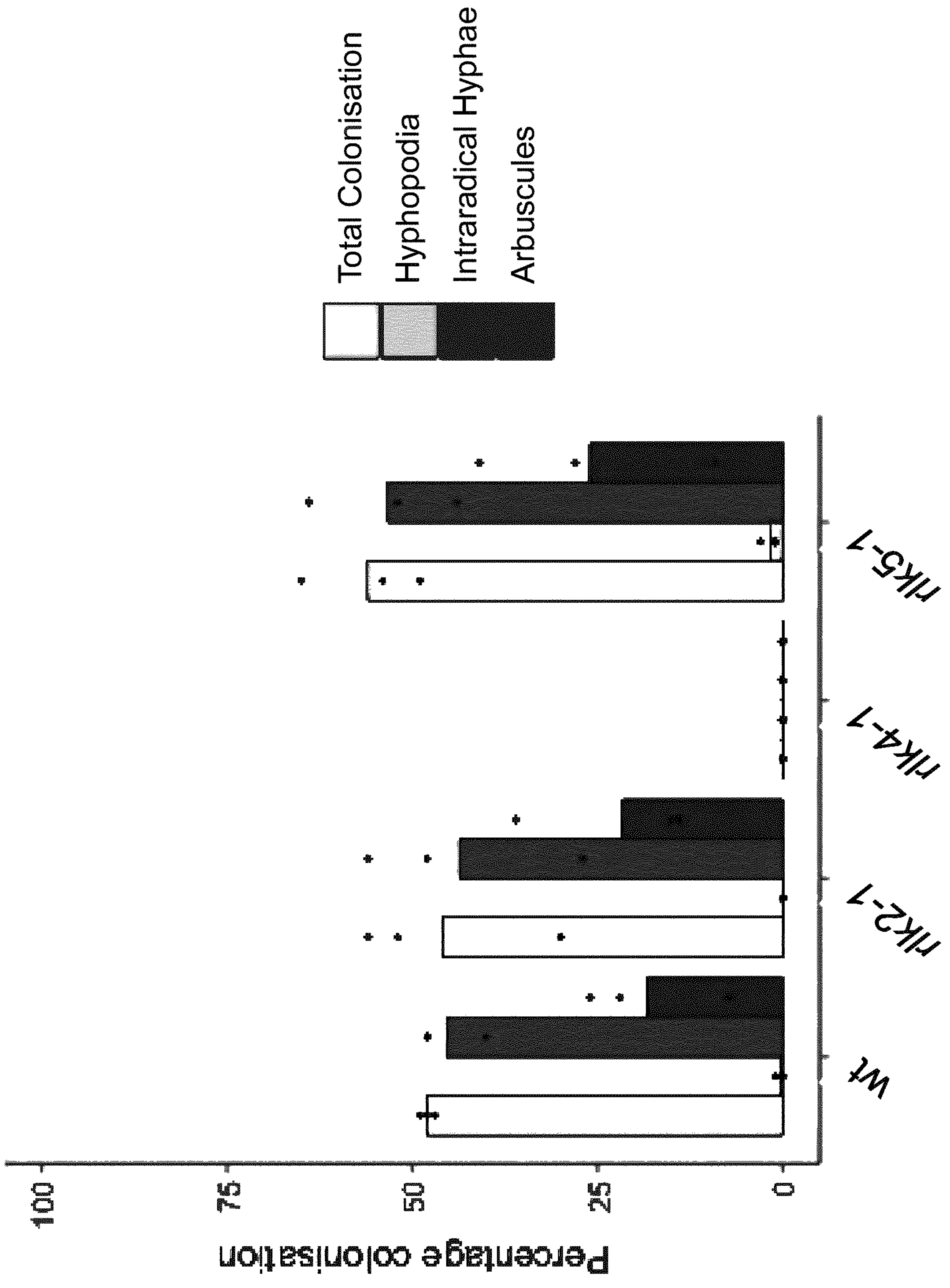

Next, it was tested whether LysM receptor-like kinase homologs were required for mycorrhizal colonization of *H. vulgare*. 10 LysM receptor-like kinase genes were found in *H. vulgare*, in particular three (including RLK4 and RLK5) that showed very close homology to CERK1, the *M. truncatula* CO receptor, and one (RLK10) that showed closed homology to NFP, the *M. truncatula* LCO receptor. Of the LysM receptor-like kinase mutants tested, rlk4-1 mutant barley were found to have a defect in mycorrhizal colonization, with almost no colonization occurring (FIG. 6C). These results showed that at least one *H. vulgare* LysM receptor-like kinase was required for mycorrhizal colonization.

*H. vulgare* epidermal root cells were treated with COs, LCOs, or peptidoglycan, and tested for their ability to generate nuclear-associated calcium oscillations associated with symbiosis signaling (symbiotic calcium oscillations) (FIG. 7). As in *M. truncatula, H. vulgare* responded to treatment with calcium oscillations. This indicated that the activation of the Sym pathway was essential for mycorrhizal colonization of *H. vulgare*, as was observed in *M. truncatula* (described in Example 1).

Figure 9:
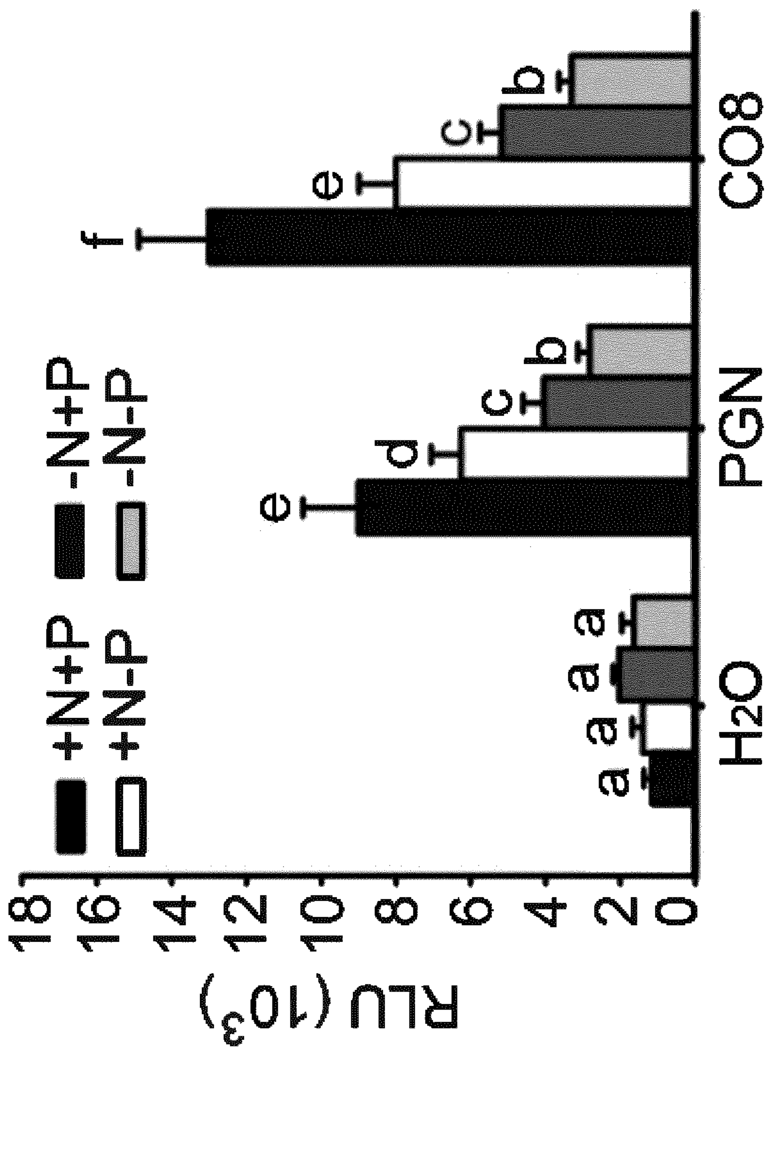
FIG. 9 provides the level of reactive oxygen species (ROS) production by *H. vulgare* in response to treatment with CO8 or peptidoglycan under different nutrient conditions. As indicated on the x-axis, plants were treated with either water ($H_2O$), peptidoglycan (PGN), or CO8. The y-axis indicates mean relative light units (RLU ($10^3$)) of the ROS assay, ±s.e.m., of a sample size of n=6. ROS formation was measured under conditions with replete nitrate and phosphate (+N+P, 5 mM $NO_3^-$ and 0.5 mM $PO_4^-$, black bars), limiting nitrate and replete phosphate (−N+P, 0 mM $NO_3^-$ and 0.5 mM $PO_4^-$ dark gray bars), replete nitrate and limiting phosphate (+N−P, 5 mM $NO_3^-$ and 0 mM $PO_4^-$, white bars), or limiting nitrate and limiting phosphate (−N−P, 0 mM $NO_3^-$ and 0 mM $PO_4^-$, light gray bars). The letter labels above each bar denote statistically significant groupings calculated with a Mann-Whitney Rank Sum Test, with P<0.05.

In addition, the role of nutrient status in mycorrhizal colonization of *H. vulgare* was examined. Symbiotic calcium oscillations upon treatment with SmLCO occurred in *H. vulgare* at a higher level under limiting nitrate and limiting phosphate conditions than they did under replete nitrate and replete phosphate conditions (FIG. 8). Furthermore, just as observed in *M. truncatula*, the formation of reactive oxygen species, an immunity-related signal, was relatively low in *H. vulgare* plants grown in limiting nitrate or phosphate and relatively high under nitrate and phosphate replete conditions (FIG. 9). Finally, mycorrhizal colonization of *H. vulgare* was tested under replete or limiting nitrate levels and a range of phosphate levels (FIGS. 10A-10C). The concentration of phosphate had little impact on the levels of mycorrhizal colonization when nitrate was limiting, whereas when nitrate was replete, there was a strong effect of phosphate concentration on colonization (FIGS. 10A-10B). Thus, both phosphorus and nitrogen levels affected the degree of mycorrhizal colonization in cereals.

Example 3. Strigolactones, Karrikins, and CEPs Contribute to Nutrient-Starvation-Induced Symbiotic Colonization The following example describes experiments to determine the roles of strigolactones, karrikins, and CEP peptides in the *H. vulgare* symbiotic response under nutrient limiting conditions.

Materials and Methods

Plant Materials and Growth Conditions

Wild type *H. vulgare* (*H vulgare* cv. Golden Promise) was grown in sand, watered with modified liquid BNM containing either replete nitrate and replete phosphate (+N+P, 5 mM $KNO_3$ and 0.5 mM $KH_2PO_4$), replete nitrate and limiting phosphate (+N−P, 5 mM $KNO_3$, no phosphate), limiting nitrate and replete phosphate (−N+P, no nitrate, 3.75 mM $KH_2PO_4$), or limiting nitrate and limiting phosphate (−N−P, no nitrate or phosphate).

LysM Receptor-Like Kinase Gene Expression

Figure 12:
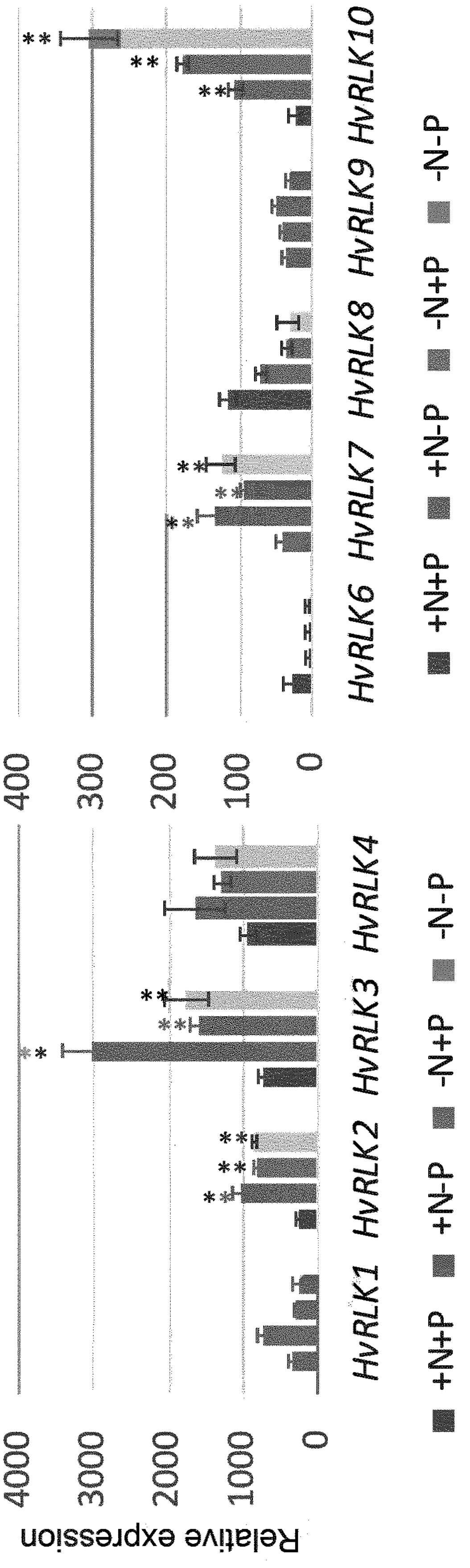
FIG. 12 provides the relative expression levels of *H. vulgare* LysM receptor-like kinase homologs determined by RNA-seq under different nutrient conditions. The *H. vulgare* LysM receptor-like kinase gene is indicated on the x-axis including, from left to right, HvRLK1, HvRLK2, HvRLK3, HvRLK4, HvRLK6, HvRLK7, HvRLK8, HvRLK9, and HvRLK10. Relative expression levels are shown on the y-axis. Relative expression values are mean±SD (n=3), based on RPKM, and ** indicates P<0.01, as determined by a Student's t-test. Expression was measured under conditions with replete nitrate and replete phosphate (+N+P, 5 mM $NO_3^-$ and 0.5 mM $PO_4^-$ dark grey bars), replete nitrate and limiting phosphate (+N−P, 5 mM $NO_3^-$ and 0 mM $PO_4^-$, grey bars), limiting nitrate and replete phosphate (−N+P, 0 mM $NO_3^-$ and 0.5 mM $PO_4^-$, light gray bars), or limiting nitrate and limiting phosphate (−N−P, 0 mM $NO_3^-$ and 0 mM $PO_4^-$, lightest grey bars).

Wild type *H. vulgare* tested in FIG. 12 was grown in sand for 21 days, watered with modified liquid BNM containing either replete nitrate and replete phosphate (+N+P, 5 mM $KNO_3$ and 0.5 mM $KH_2PO_4$), replete nitrate and limiting phosphate (+N−P, 5 mM $KNO_3$, no phosphate), limiting nitrate and replete phosphate (−N+P, no nitrate, 3.75 mM $KH_2PO_4$), or limiting nitrate and limiting phosphate (−N−P, no nitrate or phosphate). Total roots were harvested and frozen in liquid nitrogen. Frozen root tissues were ground in liquid nitrogen to a fine powder and the total RNA was extracted using the Spectrum™ Plant Total RNA kit (Sigma-Aldrich) coupled with On-Column DNase I Digestion set (Sigma-Aldrich). RNA concentration was determined by NanoDrop One (Thermo Scientific). RNA sequencing (RNA-Seq) was performed by IMGM Laboratories (Martinsried, Germany). RNA-Seq libraries were prepared with the Illumina TruSeq® Stranded mRNA HT kit and sequencing of the libraries was performed on the Illumina NextSeq500 next generation sequencing 30 system using the high output mode with 1×75 bp single-end read chemistry (Illumina, Cambridge, UK). The resulting reads from the raw fastq data were quality controlled and mapped to the reference genome of *H. vulgare* Golden Promise. The counts and RPKM (Reads per kilobase per million mapped reads) values were calculated with featureCounts in R package Rsubread. The expression levels were calculated by the RPKM values.

Treatment with Strigolactones and Karrikins

Figure 13:
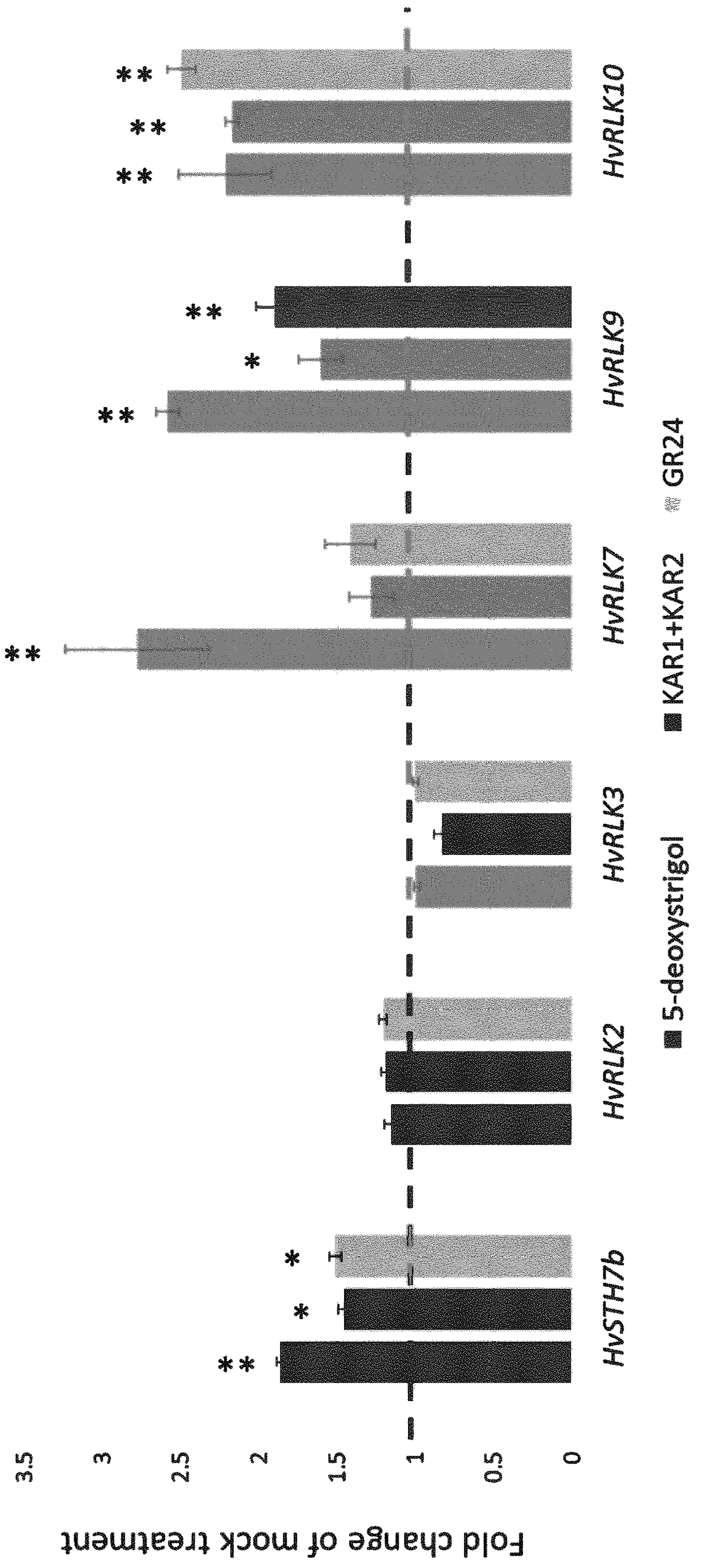

Wild type *H. vulgare* plants tested in FIG. 13 were grown on BNM plates for four days, and the plate roots were then treated with either 0.1 μM 5'-deoxystrigol (Chiralix), a mixture of 0.1 μM Karrikin 1 or 0.1 μM Karrikin 2 (Chiralix), or 0.1 μM GR24 (Chiralix) in liquid BNM for 24 hours. Plant roots were harvested and total RNA was extracted using the Spectrum™ Plant Total RNA kit (Sigma-Aldrich) coupled with On-Column DNase I Digestion set (Sigma-Aldrich). 1 mg of total RNA was used for cDNA synthesis with the SensiFAST cDNA Synthesis Kit (Bioline). Real-time quantitative PCR (RT-qPCR) was performed using SensiFAST SYBR No-ROX Kit. An *H. vulgare* ADP gene was used as a reference gene, and fold changes were calculated for 5'-deoxystrigol-, karrikins- or GR24-treated roots with respect to DMSO-treated roots (mock treatment). The primers used in the RT-qPCR are listed in Table 2. Table 2 also includes the primers used for expression analysis of *H. vulgare* CEP genes in FIGS. 25A-25D.

TABLE 2

*H. vulgare* RT-qPCR primer sequences

| Primer Name | Sequence, 5' to 3' |
|---|---|
| HvADP-F | GCTCTCCAACAACATTGCCAAC (SEQ ID NO: 32) |
| HvADP-R | GAGACATCCAGCATCATTCATTCC (SEQ ID NO: 33) |
| HvSTH7b-F | CTCATCATCGCCTTCCTCAAA (SEQ ID NO: 42) |
| HvSTH7b-R | CACCTTCACGTCGCACTC (SEQ ID NO: 43) |
| HvRLK2-F | CAACCGCACCCACACTT (SEQ ID NO: 44) |
| HvRLK2-R | GCAGCTCGGAGGTGAAATAC (SEQ ID NO: 45) |
| HvRLK3-F | CGCCTTCCTAGTCCTCCT (SEQ ID NO: 46) |
| HvRLK3-R | TTGCCGTAGCAGTTGTTCT (SEQ ID NO: 47) |
| HvRLK7-F | CGCTGCCTCTCGTCCTA (SEQ ID NO: 48) |
| HvRLK7-R | GAGGTTCGTGTCCTTGGTG (SEQ ID NO: 49) |
| HvRLK9-F | GGCCAGACATTCCTTGTTCT (SEQ ID NO: 50) |
| HvRLK9-R | CGCTAAACTCCTTCCAGGTAAA (SEQ ID NO: 51) |
| HvRLK10-F | GACGTCGTGTTCAGCCTATC (SEQ ID NO: 52) |
| HvRLK10-R | TGCCACTTCATTGACAATCCTA (SEQ ID NO: 53) |
| HvD27-F | TTTGGACAGCAACCTCCTGAAG (SEQ ID NO: 54) |
| HvD27-R | CGCGATACATTTCGTGCTGAA (SEQ ID NO: 55) |
| HvCCD7-F | GGGAGGATCACGGCTATGTTCT (SEQ ID NO: 56) |
| HvCCD7-R | CACCATCAGGTGGCATCTGTCT (SEQ ID NO: 57) |
| HvCCD8-F | CCACTTCATCAACGCGTACGA (SEQ ID NO: 58) |
| HvCCD8-R | GGAGATTGTGGAGACGGAGGTT (SEQ ID NO: 59) |
| HvCEP1-F | ATGCCGTGCAGGGTACTG (SEQ ID NO: 34) |
| HvCEP1-R | CGGCGTGCAGCTTGTTG (SEQ ID NO: 35) |
| HvCEP2-F | AGTGTGTACTGCCGCAAA (SEQ ID NO: 36) |
| HvCEP2-R | GCCTGCCATGTAACTGAAGA (SEQ ID NO: 37) |
| HvCEP3-F | CTGATGCAAGGAGGCTAGAAG (SEQ ID NO: 38) |
| HvCEP3-R | GACTTGTTCAGGAGGTGTCTC (SEQ ID NO: 39) |
| HvCEP4-F | CAGAGCAACTTCAACTGAGACTA (SEQ ID NO: 40) |
| HvCEP4-R | TGATCTTCCCTTTGTTGCCTAT (SEQ ID NO: 41) |

Nuclear Calcium Imaging

In FIGS. 11A-11B, *M. truncatula* (FIG. 11A) and *H. vulgare* (FIG. 11B) plants were grown on media containing high phosphate and limiting nitrate (3.75 mM $PO_4^-$ and 0 mM $NO_3^-$ for *M. truncatula;* 0 mM $NO_3^-$ and 0.5 mM $PO_4^-$ for *H. vulgare*). *H. vulgare* pants tested in FIG. 14A were grown on BNM media containing high nitrate and high phosphate (5 mM $NO_3^-$ and 0.5 mM $PO_4^-$). The *H. vulgare* plant tested in FIG. 15B was grown on BNM media containing high nitrate and high phosphate (5 mM $NO_3^-$ and 0.5 mM $PO_4^-$) for 3 days.

For nuclear calcium imaging, roots were removed and transferred to liquid media and treated for 12 hours with either buffer alone, 1 μM 5-deoyxstrigol (FIGS. 11A-11B, and FIG. 14A), a 1 μM mixture of karrikin 1 and karrikin 2 (FIGS. 11A-11B), or 1 μM 5-deoyxstrigol and 1 μM CEP3 (FIG. 14A). SmLCO at $10^{-7}$ M was then added to the liquid bath, while the root cells were being imaged for calcium changes. In FIG. 15B, separate roots of an *H. vulgare* seedling were treated with buffer alone and imaged. Nuclear calcium imaging was performed as described in Examples 1 and 2.

Mycorrhizal Colonization Assays

*H. vulgare* was treated with the synthetic strigolactone analog GR24 (FIGS. 14B-14C), or GR24 and CEP3 (FIG. 14D), and mycorrhizal colonization was measured (FIG. 14D). *H. vulgare* was treated with either water ($H_2O$) or water with 0.1 μM GR24 and 1 μM CEP3 twice a week from the 3rd day after inoculation. Mycorrhizal colonization assays to measure *R. irregularis* colonization of *H. vulgare* were performed as described in Example 2. The *H. vulgare* wild type seedlings tested in FIGS. 14B-14C were watered for 2 weeks after inoculation before 0.1 μM GR24 was applied with one-half strength Hoagland solution and combinations of low phosphate/high nitrate (LP/HN; low phosphate=10 μM $PO_4$; high nitrate=3 mM $NO_3^-$) and high phosphate/low nitrate (HP/LN; high phosphate=500 μM $PO_4^-$; low nitrate=0.5 mM $NO_3^-$) respectively twice a week. In the treatments without GR24, the corresponding volume of the GR24 solvent acetone was added to the one-half strength Hoagland solution. Quantification of colonization was performed 7 weeks post inoculation (FIG. 14B), 6 weeks post inoculation (FIG. 14C), or 4 weeks post inoculation (FIG. 14D).

Results

In order to determine the effect of strigolactones and karrikins on symbiotic signaling in *M. truncatula* (FIG. 11A) and *H. vulgare* (FIG. 11B), root cells were grown under high phosphate conditions and pre-treated with either strigolactone or karrikins, and symbiotic calcium oscillations were measured (FIGS. 11A-11B). Very strikingly, treatment with either strigolactones or karrikins overrode phosphate suppression of symbiotic calcium oscillations. Under replete phosphate conditions, symbiotic calcium oscillations were normally blocked (e.g., "Buff" trace in FIGS. 11A-11B). When plants grown under phosphate replete conditions were pre-treated with either strigolactone or karrikins, symbiotic calcium oscillations were observed following treatment with SmLCO.

In addition, the effect of different nutrient levels and/or strigolactone and karrikin treatment on expression levels of *H. vulgare* LysM receptor-like kinase homologs was examined. As shown in FIG. 12, several of the *H. vulgare* LysM receptor-like kinase genes were upregulated under limiting nitrate and/or phosphate conditions. In particular, RLK10, the only *H. vulgare* ortholog of the *M. truncatula* LCO receptor NFP, was substantially upregulated in nitrate and phosphate limiting conditions. In addition, expression of some of these receptors, including RLK10, were induced by application of strigolactones or karrikins (FIG. 13). Because LysM receptor-like kinase gene expression and symbiotic calcium signaling increased in response to strigolactone and karrikin treatment, this suggested that a function for strigolactone/karrikin signaling during symbiosis was the activation of the receptors necessary for LCO perception, which would then allow recognition of symbiotic microorganisms.

The impacts of strigolactone/karrikin treatments in *H. vulgare* were shown to be entirely dependent on the nitrogen status of the plant: if nitrate levels were high, there was only limited LCO induction of calcium oscillations following strigolactone/karrikin treatment ("1 μM SL" trace in FIG. 14A). This implied that a second signal, acting synergistically with the phosphate/strigolactone signal, coordinated the response to nitrogen.

CEP peptides are recognized by receptors present in the shoot, which in turn generate mobile signals to control nodule number in the root (Kereszt et al. *Frontiers in plant science* 2018 10:3389). It was tested whether CEP peptides also regulated symbiotic processes in cereals, in particular the regulation of mycorrhization, and whether CEP peptides were the missing second signal that coordinated the response to nitrogen levels. *H. vulgare* plants grown under replete nitrate and phosphate showed no nuclear calcium signaling (FIG. 14A). However, if the plants were pre-treated with a combination of strigolactones and CEP peptides, the nitrate and phosphate effect was overridden, and nuclear calcium oscillations were induced (FIG. 14A). Strikingly, this effect was limited to a single root in the *H. vulgare* seedling (FIGS. 15A-15B, and FIG. 16). This root was the longest root at the time of analysis and could be the embryonic root, but this was not always the case.

Across a time course of nutrient deprivation in *H. vulgare*, a similar phenomenon was observed, whereby a single root became responsive to LCOs at early stages of nutrient deprivation, but, as nutrient deprivation continued, a majority of the root system became LCO responsive (FIG. 16). Without wishing to be bound by theory, this suggested that by making a single root symbiotically permissive, the plant limited the risk of destructive colonization by root pathogens.

Transcriptional expression of some CEP genes is induced in *H. vulgare* under nitrogen (i.e., nitrate) starvation, as shown in FIGS. 25A-25D. Among the four CEP genes in barley, only HvCEP1 and HvCEP2 are highly induced upon nitrate starvation. HvCEP2 encodes the peptide CEP3. This indicated that nitrogen levels could regulate induction of CEP genes.

Effect of Exogenous Administration of Strigolactone and/or CEP Peptides on *H. vulgare* Mycorrhizal Colonization Mycorrhizal colonization of *H. vulgare* when treated with the synthetic strigolactone analog GR24 was examined under different nutrient conditions. GR24 promoted mycorrhizal colonization when under high phosphate and low nitrate conditions when measured at 6 weeks post inoculation (FIG. 14C). At 7 weeks post inoculation, no inhibitory effect of high phosphate on mycorrhizal colonization was observed, and so a promotion of mycorrhizal colonization due to GR24 treatment could not be observed (FIG. 14B). When CEP3 and GR24 were treated together under water treatment alone (i.e., without manipulation of the nutrient levels) an induction of mycorrhizal colonization was not observed (FIG. 14D).

Example 4. NSP1 and NSP2 Promote Strigolactone Biosynthetic Gene Expression and Mycorrhizal Colonization The following example describes the role of the transcription factors NSP1 and NSP2 in regulating mycorrhizal colonization, as well as the engineering of NSP transcription factor expression levels in *H. vulgare.*

Materials and Methods

*M. truncatula* Gene Expression Analyses

To determine the expression levels of the NSP genes as shown in FIG. 17A, and the RLK genes as shown in FIG. 24A, *M. truncatula* was grown on plates under different nutrient conditions (described in Example 1) for 5, 10, and 15 days. Gene expression was measured by RNA-seq. In addition, as shown in FIG. 17E, expression of strigolactone biosynthesis genes was measured by RNA-seq under different nutrient conditions (as in FIG. 17A), as well as in nsp1 and/or nsp2 mutant plants. *M. truncatula* RLK gene expression levels were measured by qRT-PCR (FIGS. 24B-24E), as described in Example 1. The primers used in the qRT-PCR are listed in Table 3.

TABLE 3

*M. truncatula* qRT-PCR primer sequences

| Primer Name | Sequence, 5' to 3' |
|---|---|
| Histone-F | ATTCCAAAGGCGGCTGCATA (SEQ ID NO: 24) |
| Histone-R | CTTTGCTTGGTGCTGTTTAGATGG (SEQ ID NO: 25) |
| MtKUF1-F | CCCGATCAACGATCCCATTT (SEQ ID NO: 26) |
| MtKUF1-R | CTCTCCATCCAACAGCATCTAC (SEQ ID NO: 27) |
| MtLYK10-F | AGAAGCTACGAGCCAAGGTAGC (SEQ ID NO: 1) |
| MtLYK10-R | AGGTAGCCTGGTGTTCCAACAAG (SEQ ID NO: 2) |
| MtLYK8-F | GTGGAAGCAGCATGGATAAGA (SEQ ID NO: 28) |
| MtLYK8-R | CCGTGCTAAATCCGTCAGTAG (SEQ ID NO: 29) |
| MtLYR9-F | CCAAGCCAAACTCAGCTACA (SEQ ID NO: 30) |
| MtLYR9-R | CGGAAAGTGTGACATGTTTCAATAG (SEQ ID NO: 31) |

NSP Gene Expression in *H. vulgare*

To determine the expression levels of the NSP genes as shown in FIG. 17B, wild type *H. vulgare* was grown in sand for 21 days, watered with liquid medium containing either replete nitrate and replete phosphate (+N+P, 5 mM $KNO_3$ and 0.5 mM $KH_2PO_4$), replete nitrate and limiting phosphate (+N−P, 5 mM $KNO_3$, 0 mM $KH_2PO_4$), limiting nitrate and replete phosphate (−N+P, 0 mM $KNO_3$, 3.75 mM $KH_2PO_4$), or limiting nitrate and limiting phosphate (−N−P, 0 mM $KNO_3$, 0 mM $KH_2PO_4$). Total roots were harvested and stored in −80° C. freezer. Frozen root tissues were ground in liquid nitrogen to a fine powder and the total RNA was extracted using the Spectrum™ Plant Total RNA kit (Sigma-Aldrich) coupled with On-Column DNase I Digestion set (Sigma-Aldrich). RNA concentration is determined by NanoDrop One (Thermo Scientific). RNA sequencing (RNA-Seq) was performed by IMGM Laboratories (Martinsried, Germany). RNA-Seq libraries were prepared with the Illumina TruSeq® Stranded mRNA HT kit and sequencing of the libraries was performed on the Illumina NextSeq500 next generation sequencing 30 system using the high output mode with 1×75 bp single-end read chemistry (Illumina, Cambridge, UK). The resulting reads from the raw fastq data were quality controlled and mapped to the reference genome of *H. vulgare* cv. Golden Promise. The counts and RPKM (Reads per kilobase per million mapped reads) values were calculated with featureCounts in R package Rsubread. The heatmaps of differential expression were plotted with R package pheatmap.

LysM Receptor-Like Kinase and Strigolactone Biosynthesis Gene Expression in *H. vulgare*

Wild type *H. vulgare* tested in FIGS. 19A and 19E was grown in sand for 21 days, under limiting nitrate and limiting phosphate condition (−N−P, 0 mM $KNO_3$, 0 mM $KH_2PO_4$). Wild type *H. vulgare* tested in FIGS. 19B-19E was grown in sand for 21 days, watered with modified liquid BNM medium containing either replete nitrate and replete phosphate (+N+P, 5 mM $KNO_3$, 0.5 mM $KH_2PO_4$), replete nitrate and limiting phosphate (+N−P, 5 mM $KNO_3$, 0 mM $KH_2PO_4$), limiting nitrate and replete phosphate (−N+P, 0 mM $KNO_3$, 3.75 mM $KH_2PO_4$), or limiting nitrate and limiting phosphate (−N−P, 0 mM $KNO_3$, 0 mM $KH_2PO_4$). Total root tissues were harvested and ground in liquid nitrogen to a fine powder. The total RNA was extracted from the powder using the Spectrum™ Plant Total RNA kit (Sigma) coupled with On-Column DNase I Digestion set (Sigma). 1 mg of total RNA was used for cDNA synthesis with an SensiFAST cDNA Synthesis Kit (Bioline). Real-time quantitative PCR (RT-qPCR) was performed using SensiFAST SYBR No-ROX Kit. A barley ADP gene was used as a reference. The primers used in RT-qPCR are listed in Table 2, above. The primers for RT-qPCR did not differentiate between HvCCD8 copy one (chr3Hg0246861) and HvCCD8 copy two (chr3Hg0309501).

Engineering of NSP Genes in *H. vulgare*

Mutation of NSP2: *Hordeum vulgare* cv. Golden Promise was transformed as previously described (Bartlett et al. *Plant Biotechnol*. J. 2008 7:856-866). Leaf tissue (1-2 cm leaf material) from individual hygromycin-resistant transgenic barley plants was frozen in liquid nitrogen. NSP2 was mutated via CRISPR/Cas9 activity using the target sequences of guide 2A (gacggcggccacgacctccacgg, SEQ ID NO: 188) and guide 2B (gtgaccatggaggacgtggtggg, SEQ ID NO: 189). The nsp2-2 line was generated by a 314 basepair deletion between guides 2A and 2B, and the nsp2-4 line was generated by a 3 basepair deletion at guide 2A and a 1 bp insertion at guide 2B. The nsp2-1 line was found to have the same deletion as the nsp2-4 line. A summary of the *H. vulgare* lines with NSP2 mutations that were generated is provided below in Table 4.

TABLE 4

Summary of *H. vulgare* lines with NSP2 mutations

| Lines | Genetic background | NSP2 mutation | Generation |
|---|---|---|---|
| EP20002<br>EP20006 | Golden promise | nsp2-1 | T2 |
| EP20036<br>EP20037 | Golden promise | nsp2-2 | T3 |
| EP20039<br>EP20043 | Golden promise | nsp2-4 | T3 |

Overexpression of NSP1 and NSP2: *M. truncatula* NSP1 and/or NSP2 were overexpressed in *H. vulgare* using the maize ubiquitin promoter pZmUBI1 (Lee, L. Y. et al, *Plant Physiol.* 2007 145:1294-1300), as described in Feike et al (Feike, D. et al, *Plant Biotechnology Journal* 2019 12:2234-2245) (see FIGS. 20A-20H and FIGS. 21A-21E). In addition, NSP1 and NSP2 were also codon-optimized for expression in *H. vulgare* and overexpressed, as shown in FIGS. 22A-22F. A summary of the *H. vulgare* lines engineered to overexpress *M. truncatula* NSP1 and/or NSP2 is provided below in Table 5.

TABLE 5

Summary of *H. vulgare* lines overexpressing *M. truncatula* NSP1 and/or NSP2

| Lines | Genetic background | Overexpressed gene | Generation |
|---|---|---|---|
| EP18473<br>EP18477<br>EP18478 | Golden promise | MtNSP1 | T2 |
| EP18480<br>EP18481<br>EP18482 | Golden promise | MtNSP2 | T2 |
| EP18857<br>EP18858<br>EP18759<br>EP18760<br>EP18865<br>EP18765<br>EP18766 | Golden promise | MtNSP1 and MtNSP2 | T2 |
| 2257-1-2<br>2257-6-2<br>2257-7-2<br>2257-8-<br>22257-11-2 | Golden promise | Codon-optimised MtNSP1 (SynNSP1) | T0 |
| 2258-1-2<br>2258-6-3<br>2258-10-2<br>2258-11-2<br>2258-13-2 | Golden promise | Codon-optimised MtNSP2 (SynNSP2) | T0 |

Western blotting: Overexpression of *M. truncatula* NSP homologs in *H. vulgare* was assessed by Western blot (FIG. 20A, FIGS. 22A-22B). *H. vulgare* T2 seeds were germinated on 1.5% agar. Plates were incubated at 4° C. in the dark for 3-4 days and then moved to room temperature and left wrapped in foil for 2 days. On the third day, the foil was removed and the plates were left at room temperature and lighting for an additional 2-3 days. The germinated seedlings were transferred in sand and watered with limiting nitrate and limiting phosphate (−N−P, no nitrate or phosphate). After three weeks, the whole roots were collected and ground in liquid nitrogen to a fine powder. The powder was homogenized in 5 mL Nuclei lysis buffer (50 mM Tris-HCl pH 8.0; 20 mM KCl; 2 mM EDTA; 2.5 mM MgCL2; 25% Glycerol; cOmplete™ Mini Protease Inhibitor Cocktail, Roche). The homogenate was filtered through 40 mm nylon mesh and spun down in a centrifuge at 1500 g and 4° C. for 10 minutes. The supernatant was discarded and the pellet was resuspended with 1 mL washing buffer (50 mM Tris-HCl pH 8.0; 2.5 mM MgCL2; 25% Glycerol; 0.2% Triton X-100; cOmplete™ Mini Protease Inhibitor Cocktail, Roche), then the liquid was transferred into a new EP tube. The samples were centrifuged at 1500 g and 4° C. for 10 minutes. The pellet was washed three times by resuspending and spinning, and finally the resuspended liquid was transferred into a pre-weighed EP tube that was then centrifuged at 1500 g and 4° C. for 10 minutes. The weight of the pellet was then measured, and the pellet was then suspended with proper volume of 1× Laemmli buffer according to the weight. The samples were boiled at 95° C. for 10 minutes and centrifuged at max speed for 2 minutes. The supernatant was transferred then into a new tube. 20 μL of each sample was loaded undiluted on 10% precast SDS gels (Bio-Rad). Transfer of proteins to PVDF membrane (Thermo Scientific) was carried out using the Trans-Blot SD transfer apparatus (Bio-Rad) at 4° C. for 2 hours at 100 V. The membrane was washed three times in TBS-T (100 mM Tris, pH 7.5; 150 mM NaCl; 0.1% (v/v) Tween 20) and incubated for one hour on a rocking platform at room temperature in blocking solution (TBS-T containing 5% (w/v) skimmed milk powder). The blots were incubated at 4° C. overnight with anti-FLAG or anti-Myc monoclonal primary antibody in blocking buffer. Anti-Histone 3 antibody was used as a loading control. The blots were washed six times in TBS-T and then probed with secondary antibody (anti-mouse antibody conjugated with horseradish peroxidase (HRP; Sigma-Aldrich)) at a dilution of 1:2000 in blocking buffer for 1 hour at room temperature and washed three times in TBS-T. Chemiluminescence was detected using ECL Prime (GE Life Sciences, Marlborough, MA).

Mycorrhizal Colonization Assays

Mycorrhizal colonization assays were performed as described in Example 2.

Results

Two transcription factors, NSP1 and NSP2, have been previously shown to be required for both nodulation and mycorrhization in *M. truncatula* (Kalo et al. *Science* 2005 308: 1786-1798; Smit et al. *Science* 2005 308: 1789-1791; Delaux et al. *New Phytologist* 2013 199: 59-65). Further, both NSP1 and NSP2 regulate strigolactone biosynthesis in *M. truncatula* (FIG. 17E; Liu et al. *Plant Cell* 2011 23: 3853-3865; van Zeijl et al. *BMC Plant Biology* 2015 15: 260). Without wishing to be bound by theory, this suggested that these transcription factors were necessary for the induction of the symbiotically permissive state in response to nutrient starvation through the upregulation of strigolactone biosynthesis.

The function of the NSP transcription factors was examined in *H. vulgare*. Multiple NSP homologs were found in the *H. vulgare* genome (FIGS. 17C-17D). Consistent with a connection between *H. vulgare* NSPs and nutrient starvation, *H. vulgare* NSP2 was found to be highly upregulated under limiting phosphate, and NSP1 was found to be relatively upregulated under the combination of limiting nitrate and limiting phosphate (FIGS. 17A-17B). In addition, lines of *H. vulgare* mutated in NSP2 showed dramatically reduced colonization by mycorrhizal fungi and appeared to be no longer responsive to the nutrient status of the plant (FIG. 18 and FIGS. 20C-20D). These mutant phenotypes were far stronger with regard to mycorrhization than those observed in legumes and highlighted the essential role of NSP2 in colonization of *H. vulgare* by mycorrhizal fungi.

Furthermore, the expression levels of the *H. vulgare* LysM receptor-like kinase homologs that showed increased expression under limiting nitrate (see FIG. 12) were compared between wild type *H. vulgare* and *H. vulgare* mutant in NSP2. RLK10 expression was reduced in the nsp2 mutant plants grown under limiting nitrogen and phosphate (FIG. 19A). RLK10, therefore, required NSP2 for its normal expression levels. Without wishing to be bound by theory, these results suggested that RLK10 may be the LCO receptor in *H. vulgare*.

In addition, the expression levels of *H. vulgare* strigolactone biosynthesis genes were analyzed. As shown in FIG. 19B, limiting nitrate and limiting phosphate significantly increased gene expression of HvD27, HvCCD7, and HvCCD8. In FIG. 19C, wild type *H. vulgare* and *H. vulgare* mutant in NSP2 were compared. Gene expression of HvD27, HvCCD7, and HvCCD8 was significantly decreased in the nsp2 mutant plants compared to the wild type *H. vulgare* plants.

The effects of nutrient starvation and strigolactone and/or karrikin treatment on the expression of *M. truncatula* LysM receptor-like kinase (LysM RLK) genes were tested. As shown in FIG. 24A, the strongest induction of the LysM RLK genes MtLYK8, MtLYR9, and MtLYK10 was seen under limiting nitrate and limiting phosphate. As shown in FIGS. 24B-24E, treatment with the synthetic strigolactone analog GR24 significantly increased LysM RLK gene expression compared to mock treatment for MtKUF1, MtLYK8, and MtLYK10. Similarly, when treated with strigolactone-biosynthesis inhibitor TIS108 (to inhibit endogenous strigolactone production), LysM RLK gene expression was either the same or lower than the expression level observed with mock treatment, but when treated with both TIS108 and GR24, LysM RLK gene expression was significantly increased in MtKUF1, MtLYK8, MtLYR9, and MtLYK10. These results indicate that both nutrient levels and strigolactones and/or karrikins regulate the expression of LysM RLK genes in *M. truncatula.*

As discussed above, NSP1 and NSP2 regulate strigolactone biosynthesis in *M. truncatula*. It was therefore tested whether overexpression of these transcription factors alone was sufficient to override phosphate suppression. Lines of *H. vulgare* overexpressing *M. truncatula* NSP1, NSP2, or NSP1 and NSP2 were generated (FIGS. 20A-20B, FIG. 21A). Overexpression of NSP1 was confirmed by Western blot (FIG. 20A) and RT-qPCR (FIG. 20B), and overexpression of NSP2 was confirmed by RT-qPCR (FIG. 20B). Plants constitutively overexpressing NSP2 and NSP1/NSP2 showed constitutively high levels of mycorrhizal colonization, independent of the concentrations of phosphate applied (FIGS. 20C-20G). Throughout testing, the NSP2 overexpression line NSP2-1 had an increased level of mycorrhizal colonization, which was consistently found to be statistically significant relative to WT. The NSP2 overexpression line NSP2-2 and the NSP1 overexpression line NSP1-2 showed similar trends toward more mycorrhizal colonization, but these trends were not statistically significant. For example, at 500 μM phosphate, the NSP2 overexpression line NSP2-2 showed an increase in mycorrhizal colonization, but the effect was not significant (FIG. 20D). Further testing showed that the amount of mycorrhizal colonization appeared to be limited at exceptionally high phosphate concentrations. FIG. 20I shows the results of testing double the phosphate concentrations as in the previous tests. Even at this high phosphate concentration, significantly higher levels of mycorrhizal colonization were observed in the NSP2 overexpression line NSP2-1. Comparable levels of colonization as in wild type plants grown under low phosphate conditions could, however, not be recapitulated. At 1 mM phosphate, the NSP2 overexpression line NSP2-2 again showed an increase relative to WT, but the effect was not significant, as at 500 μM phosphate in FIG. 20D. The NSP1/NSP2 overexpression lines had comparable and low levels of colonization, as did WT under these high phosphate conditions.

Figure 21F:
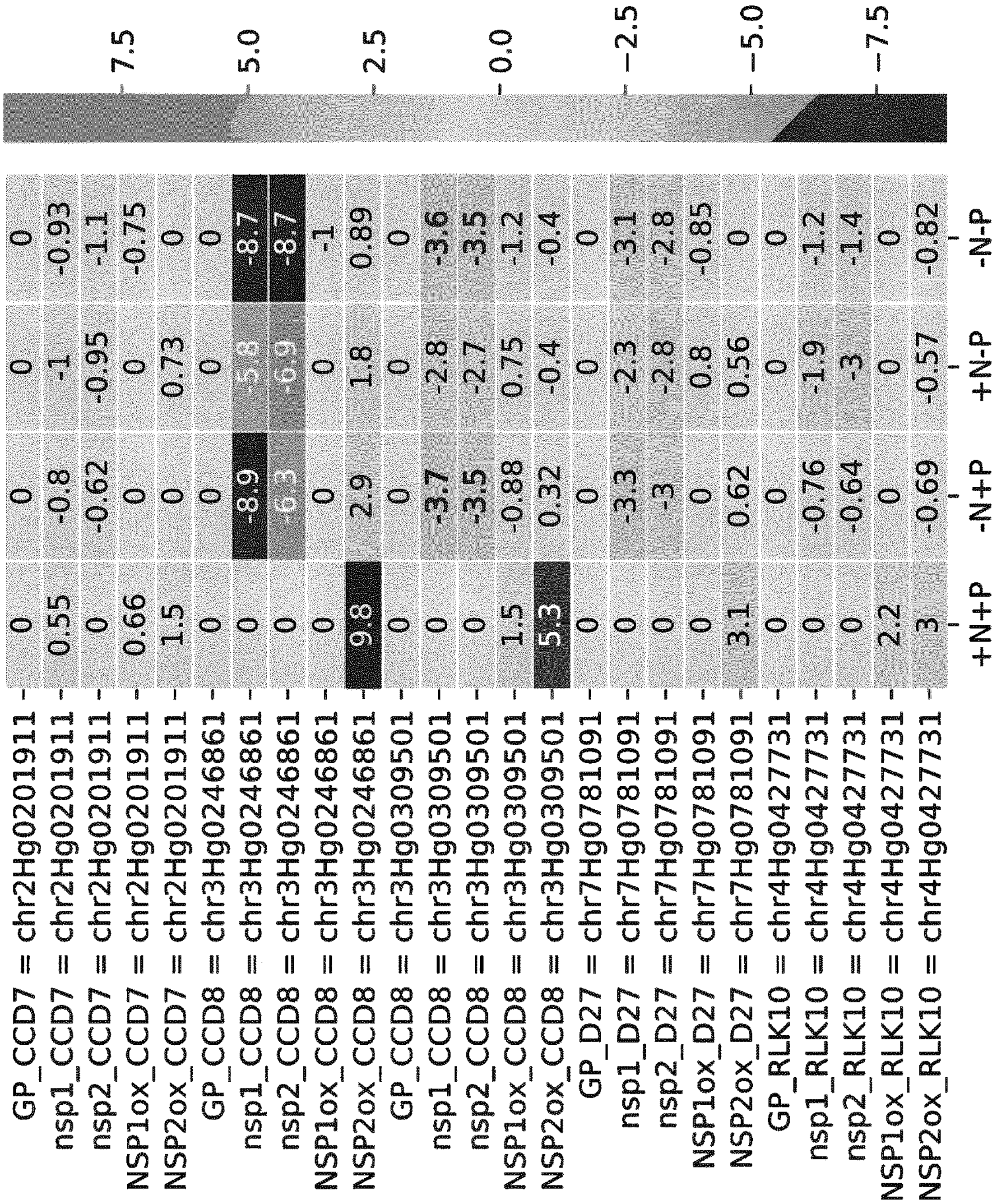

Furthermore, overexpression of NSP1 and NSP2 overrode the inhibitory effects of replete nutrient conditions on gene expression (FIGS. 21B-21E). Regulation of the symbiotically permissive state in cereals was therefore re-wired by engineering NSP expression levels such that the plant was driven toward mycorrhizal colonization even under replete phosphate conditions. However, the greatest effect on driving the symbiotically permissive state was observed in lines overexpressing NSP2 alone (FIGS. 20D and 20I). To more fully understand the roles of NSP1 and NSP2 in the response to nutrient treatments an RNA-seq analysis was undertaken with nsp1 and nsp2 mutant lines, as well as lines overexpressing NSP1 and NSP2, grown in a range of nutrient conditions. The results of this analysis are shown in FIG. 21F. These results demonstrate that all of the genes constitutively induced by NSP2 overexpression are also dependent on NSP1 and NSP2 during low nutrient induction. Specifically, endogenous NSP1 and NSP2 seem to be required in barley for gene induction under nutrient starvation conditions. Without wishing to be bound by theory, these results indicate that NSP1 and NSP2 promote the expression of these genes under low nutrient conditions, and when NSP2 is overexpressed, it drives the expression of these genes even under high nutrient conditions. Consistent with the effects on arbuscular mycorrhizal colonization a strong impact on the induction of gene expression under nutrient replete conditions in lines overexpressing NSP2 was observed, but only a mild effect in lines overexpressing NSP1. In particular, NSP2 overexpression alone was sufficient to drive the expression of strigolactone biosynthesis genes under nutrient replete conditions. From the results described above, it appears that *M. truncatula* NSP2 works well to drive symbiotic permissibility in barley, whereas *M. truncatula* NSP1 is not particularly effective. It is possible that overexpression of the barley homologs of NSP1 and NSP2 would result in a different effect.

Furthermore, NSP1 and NSP2 were also codon-optimized for expression in *H. vulgare* and overexpressed (FIGS. 22A-22D). Overexpression of codon-optimized NSP1 and NSP2 was confirmed by Western blot (FIGS. 22A-22B), and RT-qPCR (FIGS. 22C-22D). Codon-optimization and overexpression of NSP1 or NSP2 resulted in an increase in expression of HvD27 and HvRLK10, as seen in FIGS. 22E-22F. Indeed, the codon-optimized versions of NSP1 and NSP2 showed measurable increases in NSP2 and NSP1 protein overexpression, and induction of both HvD27 and HvRLK10.

FIG. 23 provides a schematic diagram showing a model for the regulation of LCO receptors and symbiosis signaling during nutrient starvation in barley.

Example 5. Characterizing Engineered *H. vulgare* Lines

The following example describes additional characterization of the *H. vulgare* mutant lines and *H. vulgare* overexpression lines described in Example 4. Further *H. vulgare* lines will also be generated. In particular, the genes RLK10 and NSP1 will be further characterized.

Materials and Methods

Engineering of *H. vulgare*

Transgenic *H. vulgare* lines will be generated using the procedures described in Example 4. Independent transgenic *H. vulgare* lines mutant in NSP1, mutant in RLK10, and overexpressing RLK10 will be generated.

Materials and Methods for Characterizing *H. vulgare* Lines

Transgenic *H. vulgare* lines from Example 4 and newly engineered transgenic *H. vulgare* lines will be characterized in order to determine whether RLK10 is an LCO receptor and whether NSP1 is also necessary for strigolactone biosynthetic gene expression and symbiotic colonization.

The expression of strigolactone biosynthetic genes in *H. vulgare* lines mutant in NSP1 will be determined using the materials and methods described in Example 4. Symbiotic colonization of *H. vulgare* lines mutant in NSP1 will be determined using the materials and methods described in Example 2.

Symbiotic colonization of *H. vulgare* lines mutant in RLK10 will be determined using the materials and methods described in Example 2. *H. vulgare* lines mutant in RLK10 will be tested for transcriptional responses to treatment with COs and LCOs.

*H. vulgare* overexpression lines with overexpressed NSP1 and/or NSP2 will be characterized in order to determine whether they are colonized by associative bacteria, including *rhizobia.*

Example 6. Engineering Overexpression of NSP1 and NSP2 in *M. truncatula* and *Marchantia Polymorpha*

The following example describes engineering of *M. truncatula* and M *polymorpha* overexpression lines. In particular, the transcription factors NSP1 and NSP2 will be overexpressed in, and their effect on mycorrhizal colonization and gene expression will be tested.

Materials and Methods

Materials and Methods for Generating Plant Mutant Lines

*M. truncatula* lines will be generated to overexpress NSP1 and/or NSP2. *M. truncatula* lines will be generated as described in Example 2. NSP1 and/or NSP2 will be overexpressed.

*M. polymorpha* lines will be generated to overexpress NSP1 and/or NSP2.

Materials and Methods for Characterizing Plant Overexpression Lines

*M. truncatula* and *M. polymorpha* overexpression lines with overexpressed NSP1 and/or NSP2 will be characterized in order to determine whether they have elevated levels of mycorrhizal colonization. Mycorrhizal colonization levels for *M. truncatula* and M *polymorpha* will be determined using the materials and methods described in Example 2.

Gene expression levels will be measured in *M. truncatula* roots by qPCR. For example, the expression levels of the strigolactone biosynthetic enzyme genes GGPS, D27, CCD7, CCD8, and MAX1 will be measured using the qPCR primers in Table 6. *M. polymorpha* gene expression levels will also be measured.

TABLE 6

*M. truncatula* qPCR primer sequences

| Primer Name | Sequence, 5' to 3' |
|---|---|
| GGPS-F | TGTCCGTCCGGTACTCTGTATTGC (SEQ ID NO: 60) |
| GGPS-R | CGCATGCCGATGGAATTGATGC (SEQ ID NO: 61) |
| MtD27-F | GAGATGATATTCGGCCAGGAAC (SEQ ID NO: 62) |
| MtD27-R | GCATGGTTTTTCTTAGCCTTGC (SEQ ID NO: 63) |
| MtCCD7-F | GATGTGGGGGAAGAAGCTATTG (SEQ ID NO: 64) |
| MtCCD7-R | TCCCAATCGTATCCAACGTG (SEQ ID NO: 65) |
| MtCCD8-F | GAAGATGGGAGGGTAACTGCTG (SEQ ID NO: 66) |
| MtCCD8-R | AGAACATCTTCGCCGTTAAATG (SEQ ID NO: 67 |
| MtPT4- F | GACACGAGGCGCTTTCATAGCAGC (SEQ ID NO: 68) |
| MtPT4-R | GTCATCGCAGCTGGAACAGCACCG (SEQ ID NO: 69) |
| MtUbiquitin-F | GCAGATAGACACGCTGGGA (SEQ ID NO: 70) |
| MtUbiquitin-R | AACTCTTGGGCAGGCAATAA (SEQ ID NO: 71) |

Results

NSP1 is necessary for symbiotic colonization of *H. vulgare.*

RLK10 is an LCO receptor. RLK10 is necessary for *H. vulgare* mycorrhizal colonization and transcriptional responses to COs and LCOs.

Results

Overexpression of NSP1 and/or NSP2 results in an increase in strigolactone biosynthetic enzyme gene expression in *M. truncatula* and M *polymorpha.*

Overexpression of NSP1 and/or NSP2 results in increased mycorrhizal colonization in *M. truncatula*

SEQUENCE LISTING (241 sequences)

SEQ ID NO: 1 - DNA, 22 bp, Artificial Sequence
  Synthetic Construct
agaagctacgagccaaggtagc

SEQ ID NO: 2 - DNA, 23 bp, Artificial Sequence
  Synthetic Construct
aggtagcctggtgttccaacaag

SEQ ID NO: 3 - DNA, 22 bp, Artificial Sequence
  Synthetic Construct
ggctcaaatggagggtctattg

SEQ ID NO: 4 - DNA, 19 bp, Artificial Sequence
  Synthetic Construct
gctttgccttcctcaacct

SEQ ID NO: 5 - DNA, 21 bp, Artificial Sequence
  Synthetic Construct
ggctgacatccttacacaaga

SEQ ID NO: 6 - DNA, 21 bp, Artificial Sequence
  Synthetic Construct
agaattgagggcatcgagaaa

SEQ ID NO: 7 - DNA, 22 bp, Artificial Sequence
  Synthetic Construct
ccatgatagcgcagaaacaatc

SEQ ID NO: 8 - DNA, 22 bp, Artificial Sequence
  Synthetic Construct
ccttcccgtttcctttcctatt

SEQ ID NO: 9 - DNA, 21 bp, Artificial Sequence
  Synthetic Construct
gccagttgcatttaggattca

SEQ ID NO: 10 - DNA, 20 bp, Artificial Sequence
  Synthetic Construct
gcacctggagcaagaacact

SEQ ID NO: 11 - DNA, 24 bp, Artificial Sequence
  Synthetic Construct
ctttgcttggtgctgtttagatgg

SEQ ID NO: 12 - DNA, 20 bp, Artificial Sequence
  Synthetic Construct
attccaaaggcggctgcata

SEQ ID NO: 13 - DNA, 23 bp, Artificial Sequence
  Synthetic Construct
agttcttgcaaggcctacagatg

SEQ ID NO: 14 - DNA, 24 bp, Artificial Sequence
  Synthetic Construct
tgattcctgttgctgcttgaacac

SEQ ID NO: 15 - DNA, 20 bp, Artificial Sequence
  Synthetic Construct
caagatcccgttcgtgccta

SEQ ID NO: 16 - DNA, 20 bp, Artificial Sequence
  Synthetic Construct
gcgttcaggttgtcaagagc

SEQ ID NO: 17 - protein, 15 aa, Artificial Sequence
  Synthetic Construct
  VARIANT 7, 11: Xaa = hydroxyproline
DSRGTAXGHSXGIGN

SEQ ID NO: 18 - protein, 15 aa, Artificial Sequence
  Synthetic Construct
  VARIANT 11: Xaa = hydroxyproline
DSRGTAPGHSXGIGN

SEQ ID NO: 19 - protein, 15 aa, Artificial Sequence
  Synthetic Construct
  VARIANT 11: Xaa = hydroxyproline
DGRGTGQGHSXGIGN

SEQ ID NO: 20 - protein, 15 aa, Artificial Sequence
  Synthetic Construct
  VARIANT 7, 11: Xaa = hydroxyproline
QVESTTXGHSXSIGH

SEQ ID NO: 21 - protein, 15 aa, Artificial Sequence
  Synthetic Construct
  VARIANT 11: Xaa = hydroxyproline
QVESTTPGHSXSIGH

SEQ ID NO: 22 - protein, 15 aa, Artificial Sequence
  Synthetic Construct
  VARIANT 7, 11: Xaa = hydroxyproline
ESRGTAXGNSXGIGN

SEQ ID NO: 23 - protein, 15 aa, Artificial Sequence
  Synthetic Construct
  VARIANT 11: Xaa = hydroxyproline
ESRGTAPGNSXGIGN

SEQ ID NO: 24 - DNA, 20 bp, Artificial Sequence
  Synthetic Construct
attccaaaggcggctgcata

SEQ ID NO: 25 - DNA, 24 bp, Artificial Sequence
  Synthetic Construct
ctttgcttggtgctgtttagatgg

SEQ ID NO: 26 - DNA, 20 bp, Artificial Sequence
  Synthetic Construct
cccgatcaacgatcccattt

SEQ ID NO: 27 - DNA, 22 bp, Artificial Sequence
  Synthetic Construct
ctctccatccaacagcatctac

SEQ ID NO: 28 - DNA, 21 bp, Artificial Sequence
  Synthetic Construct
gtggaagcagcatggataaga

SEQ ID NO: 29 - DNA, 21 bp, Artificial Sequence
  Synthetic Construct
ccgtgctaaatccgtcagtag

SEQ ID NO: 30 - DNA, 20 bp, Artificial Sequence
  Synthetic Construct
ccaagccaaactcagctaca

SEQ ID NO: 31 - DNA, 25 bp, Artificial Sequence
  Synthetic Construct
cggaaagtgtgacatgtttcaatag

SEQ ID NO: 32 - DNA, 22 bp, Artificial Sequence
  Synthetic Construct
gctctccaacaacattgccaac

SEQ ID NO: 33 - DNA, 24 bp, Artificial Sequence
  Synthetic Construct
gagacatccagcatcattcattcc

SEQ ID NO: 34 - DNA, 18 bp, Artificial Sequence
  Synthetic Construct
atgccgtgcagggtactg

SEQ ID NO: 35 - DNA, 17 bp, Artificial Sequence
  Synthetic Construct
cggcgtgcagcttgttg

SEQ ID NO: 36 - DNA, 18 bp, Artificial Sequence
  Synthetic Construct
agtgtgtactgccgcaaa

SEQ ID NO: 37 - DNA, 20 bp, Artificial Sequence
  Synthetic Construct
gcctgccatgtaactgaaga

SEQ ID NO: 38 - DNA, 21 bp, Artificial Sequence
  Synthetic Construct
ctgatgcaaggaggctagaag

SEQ ID NO: 39 - DNA, 21 bp, Artificial Sequence
  Synthetic Construct
gacttgttcaggaggtgtctc

SEQ ID NO: 40 - DNA, 23 bp, Artificial Sequence
  Synthetic Construct
cagagcaacttcaactgagacta

SEQ ID NO: 41 - DNA, 22 bp, Artificial Sequence
  Synthetic Construct
tgatcttccctttgttgcctat

SEQ ID NO: 42 - DNA, 21 bp, Artificial Sequence
  Synthetic Construct
ctcatcatcgccttcctcaaa

SEQ ID NO: 43 - DNA, 18 bp, Artificial Sequence
  Synthetic Construct
caccttcacgtcgcactc

SEQ ID NO: 44 - DNA, 17 bp, Artificial Sequence
  Synthetic Construct
caaccgcacccacactt

SEQ ID NO: 45 - DNA, 20 bp, Artificial Sequence
  Synthetic Construct
gcagctcggaggtgaaatac

SEQ ID NO: 46 - DNA, 18 bp, Artificial Sequence
  Synthetic Construct
cgccttcctagtcctcct

SEQ ID NO: 47 - DNA, 19 bp, Artificial Sequence
  Synthetic Construct
ttgccgtagcagttgttct

SEQ ID NO: 48 - DNA, 17 bp, Artificial Sequence
  Synthetic Construct
cgctgcctctcgtccta

SEQ ID NO: 49 - DNA, 19 bp, Artificial Sequence
  Synthetic Construct
gaggttcgtgtccttggtg

SEQ ID NO: 50 - DNA, 20 bp, Artificial Sequence
  Synthetic Construct
ggccagacattccttgttct

SEQ ID NO: 51 - DNA, 22 bp, Artificial Sequence
  Synthetic Construct
cgctaaactccttccaggtaaa

SEQ ID NO: 52 - DNA, 20 bp, Artificial Sequence
  Synthetic Construct
gacgtcgtgttcagcctatc

SEQ ID NO: 53 - DNA, 22 bp, Artificial Sequence
  Synthetic Construct
tgccacttcattgacaatccta

SEQ ID NO: 54 - DNA, 22 bp, Artificial Sequence
  Synthetic Construct
tttggacagcaacctcctgaag

SEQ ID NO: 55 - DNA, 21 bp, Artificial Sequence
  Synthetic Construct
cgcgatacatttcgtgctgaa

SEQ ID NO: 56 - DNA, 22 bp, Artificial Sequence
  Synthetic Construct
gggaggatcacggctatgttct

SEQ ID NO: 57 - DNA, 22 bp, Artificial Sequence
  Synthetic Construct
caccatcaggtggcatctgtct

SEQ ID NO: 58 - DNA, 21 bp, Artificial Sequence
  Synthetic Construct
ccacttcatcaacgcgtacga

SEQ ID NO: 59 - DNA, 22 bp, Artificial Sequence
  Synthetic Construct
ggagattgtggagacggaggtt

SEQ ID NO: 60 - DNA, 24 bp, Artificial Sequence
  Synthetic Construct
tgtccgtccggtactctgtattgc

SEQ ID NO: 61 - DNA, 22 bp, Artificial Sequence
  Synthetic Construct
cgcatgccgatggaattgatgc

SEQ ID NO: 62 - DNA, 22 bp, Artificial Sequence
  Synthetic Construct
gagatgatattcggccaggaac

SEQ ID NO: 63 - DNA, 22 bp, Artificial Sequence
  Synthetic Construct
gcatggtttttcttagccttgc

SEQ ID NO: 64 - DNA, 22 bp, Artificial Sequence
  Synthetic Construct
gatgtgggggaagaagctattg

SEQ ID NO: 65 - DNA, 20 bp, Artificial Sequence
  Synthetic Construct
tcccaatcgtatccaacgtg

SEQ ID NO: 66 - DNA, 22 bp, Artificial Sequence
  Synthetic Construct
gaagatgggagggtaactgctg

SEQ ID NO: 67 - DNA, 22 bp, Artificial Sequence
  Synthetic Construct
agaacatcttcgccgttaaatg

SEQ ID NO: 68 - DNA, 24 bp, Artificial Sequence
  Synthetic Construct
gacacgaggcgctttcatagcagc

SEQ ID NO: 69 - DNA, 24 bp, Artificial Sequence
  Synthetic Construct
gtcatcgcagctggaacagcaccg

SEQ ID NO: 70 - DNA, 19 bp, Artificial Sequence
  Synthetic Construct
gcagatagacacgctggga

SEQ ID NO: 71 - DNA, 20 bp, Artificial Sequence
  Synthetic Construct
aactcttgggcaggcaataa

SEQ ID NO: 72 - protein, 542 aa, Lotus japonicus
MTMEPNSTTSDHILDWLEGSVSFFPSFLDEPCNNSGYIQEYHLWDQYQTDANTGSSPNATNSTTATIVATSATSTTSLEPCGSNNNQPLSDLPKKRNATDESSLKPPQNKNKRIKTRPMNEPENGDAVRKNKKGGAKANGSNCNSGNSKEGRWAEQLLNPCAAAIAGGNVNRVQHLLYVLHELASPTGDPNHRLAAHGLRALTHHLSSSSSSPTSSGTITFASTEPRFFQKSLLKFYEVSPWFSFPNNIANASILQVLAEEANITSRTLHILDIGVSHGVQWPTLLDALSRRSGGPPSVVRLTVVTAENDQNMETPFSKAPPGYNYYPRLLGYAQSIKINLQINRIENHSLQTLNAQSISASPDEILIVCAQFRLHHLNHNSPDERSEFLKVLGNMEPRGVILSENNTECCCSGCGNFAAGFTRRVEYLWRFLDSTSSAVKGRESDERREMEGEAAKALTNQREMNEEKEKWCGRMKEAGFAGEVFGEDAVDGGRALLRKYDSNWEMKVEEKNTSVGLWWKGQPVSFCSLWKLDGNDQGGTS

SEQ ID NO: 73 - protein, 57 aa, Lotus japonicus
MEGEAAKALTNQREMNEEKEKWCGRMKEAGFAGEVFGEDAVDGGRALLRKYDSNWEM

SEQ ID NO: 74 - protein, 161 aa, Cicer arietinum
MINIHGTALYLALYTDVTNSKELLESMQAGTLEPEVALLNASLIPDIFPVLAAAHKTLEAKSRDSLTTRTLHSELVYNYSGSKHITESLKRCGVSENTAYILVVRFDATPDEIKAIEKLVIGKEISVEELEGRANQSQIQKQYKISASELGVSSLADAITC

SEQ ID NO: 75 - protein, 496 aa, Solanum tuberosum
MAMMVDETISDFDCYGSLSTPTTTITTTTTSSSSEDDHGCTWNDWSPVFDWDAFSGGDNFQDLIESMIQGSGNCFHNSEEDSAEIMEEEEEEESGDSNNNQSEDINGLKLVHLLMAAAEALTGVNKSRELARVILVRLKELASPNGATNMERLAAHFTDALQALLDGAASGTLHAKLMFSPNYKDEHHQGDVLAAFQLLQDMSPFVKFGHFTANQAIFESVTHDRRVHIVDYDIMEGIQWASLMQALVSRKDGPPTPHLRITALSRSGSGRRSFGTVQETGRRLTAFATSIGQPFSFHHCRLDSDEIFKPTNLKLVRGEALIINCMLHLPHFSYRASDSVASFLSGSKTLNPRLVTLVEEELRPIGDEEGFMGRFMDTLHHYSALYDSLEAGFPLQSRARALVERVFLGPRITGSLARIYRARGEEERCSWGEWLSGVGFCESNISFANHCQAKLLLGLFNDGYRVEEIGTNKLVLGWKSRRLLSASIWTTMDIDL

SEQ ID NO: 76 - protein, 606 aa, Medicago truncatula
MLETIELKSLWFYDLIPILLLFLVNDPTLLTSSNPSNFLLQYLIVFFCFFITMTMEPNPTSDHILDWLEGSVSFFPSFLDDPYNNGYIHEYEIWNQNQDISNQYQIDANTNSSNATNSTTNIVAASTTTSTTSLEPNSFNNIPFSDLPKKRNAEDELSLKKQPQNQKNKRLKSRPMNESDNGDAALEGTVVRKSGGNKKGAAKANGSNSNNGNNKDGRWAEQLLNPCAVAITGGNLNRVQHLLYVLHELASTTGDANHRLAAHGLRALTHHLSSSSSSTPSGTITFASTEPRFFQKSLLKFYEFSPWFSFPNNIANASILQVLAEEPNNLRTLHILDIGVSHGVQWPTFLEALSRRPGGPPPLVRLTVVNASSSTENDQNMETPFSIGPCGDTFSSGLLGYAQSLNVNLQIKKLDNHPLQTLNAKSVDTSSDETLIVCAQFRLHHLNHNNPDERSEFLKVLRGMEPKGVILSENNMECCCSSCGDFATGFSRRVEYLWRFLDSTSSAFKNRDSDERKMMEGEAAKALTNQREMNERREKWCERMKEAGFAGEVFGEDAIDGGRALLRKYDNNWEMKVEENSTSVELWWKSQPVSFCSLWKLDKQPE

SEQ ID NO: 77 - protein, 566 aa, Trifolium pratense
MTMEPNPTSDHILDWLEGSVSFFPSFLDDPYNNGYIQEYPLWDQNQDIHNQYQIDVNTNSPNGTNSTNNIVAASTTTTTTSTTSLEPISSNNIPFSDLPKKRNAEDEPGLKKQSQNQKNKRIKSRPTNEADNGDAAIEGTVVRKPGGNKKGAGKASGNNSGNGNNKDGRWAEELLNPCAAAITGGNLNRVQHLLYVLHELASTTGDANHRLAAHGLRALTHHLSSSSSSTTSGTITFASTEPRFFQKSLLKFYEVSPWFSFPNNIANASILQVLAEEPNSSRSLHILDIGVSHGVQWPTFLEALSRRPGGPPPLVRLTVVTASSTENDQNMETPFSVGPCGDNFSSRLLGYAQSINVNLQINKLDNHPLQTLNAQSVDTSPDETLIVCAQFRLHHLNHNAPDERREFLKVLRDMEPKGVILSENNMECCCSSCGDFATGFSRRVEYLWRFLDSTSSAFKGRESDERRMMEGEAAKALTNQREMNEGKEKWCERMKEAGFAGEVFGEDAIDGGRALLRKYDNNWEMKVEEENSTTVGLWWKGQPVSFCSLWKLDKQNSSSSTLTAKL

SEQ ID NO: 78 - protein, 559 aa, Trifolium subterraneum
MTMEPNPTSDHILDWLEGSVSFFPSFLDDPYNNGYIQEYPLWDQNQDINNQYRIDVNTNSPNGTNNIVAASTTTSTTSLEPNSSNNIPFSDLPKKRNAEDESGLKKQSHSQKNKRIKSRPANEADNGDAAIEGTVVRKPGGNKKGAGKANGNNSSNGNNKDGRWAEELLNPCAAAITGGNLNRVQHLLYVLHELASTTGDANHRLAAHGLRALTHHLSSSSSSTTSGTITFASTEPRFFQKSLLKFYEVSPWFSFPNNIANASILQVLAEEPNNSRSLHILDIGVSHGVQWPTFLEALSRRPGGPPPLVRLTVVTASSTENDQNMETPFSVGPCGDNFSSRLLGYAQSINVNLHINKLDNHPLQTLNAQSVDISPDETLIVCAQFRLHHLNHNTPDERSEFLKALRDMEPKGVILSENNMDCCCSSCGDFATGFSRRVDYLWRFLDSTSSAFKGRESDERRMMEGEAAKALTNQREMNEGKEKWCERMKEAGFAGEVFGEDAIDGGRALLRKYDNNWEMKVEEENSTTVGLWWKGQPVSFCSLWKLDKHSSSSTLTAKL

SEQ ID NO: 79 - protein, 561 aa, Lupinus albus
MTMEPHQTSDHIIDWLEGSISYFPSFLDDSYNSGEIQQYQLWDQDISQYHNNTNIDSLNAINPNTNTIAAATSTTTSTTPPEPYDSSNIPLSDLAKKKNATDVISLKPSQNQKYKKIKSRPTNKPENGDKVIKGTTTVTRKSGGKKKGSAKSNANNLNNRNNKEGRWAEQLLNPCAVAISGGNLNRVQHLLYVLHELASATGDANHRLAAHGLKALTHHLSSSSSSSSSATSSGVITFASSESRFFQKSLLKFYEVSPWFSFPNNIANASILQVLAEAPNSMRTLHILDIGVSHGMQWPIFLEALSRRPGGPPPLVRLTVVTAENEQNKETPFSVGPPGDNFSSRLLGFAKSMNINLQIKKLDNHPLQSLNAKIIDTSPDEAFIVCAQFRLHHLNHNATNERNEFLKVLRNMEPQGVIISENNMECCCNSCGNFADGFCRRVEYLWRFFDSTSSAFKGRECDERSVMEGEAAKILTNQREMNEGKEKWFERMREAGFVWQMFGEDAIDGGQALLRKYDSNWETKVEENNASVELWWKGQPVSFCSLWKLDGNYKSRFRDRL

SEQ ID NO: 80 - protein, 568 aa, Lupinus angustifolius
MTMEPHQTSDHILDWLESSVSYFPSFLDEPYNSGEVQEYQLWDQEDQHTVSQYHIDANIDSLNAINPNSNTNTIAAATSTTTSTTPPEPYDSSNIPLFDMPKKKNATDVLSLKPTQNHKYKKIKSRPMNKRENRDTVIKETTTVIRKSSGNKKGSAKANANNLNNRNNKEGRWAEQLLNPCAVAISGGNLNRVQHLLYVLNELASPTGDANHRLAAHGLKALTHHLSSSSLSSSSSATSSGVITFASADPRFFQKSLLKFYEVSPWFSFPNNIANASILQVLAEAPNSTRTLHILDIGVSHGMQWPIFLEALSRKPGGPPPLVRLTVVTAENEQNKETPFSVGPPGDNFSSRLLGFAKSMNINLQIKKLDNHPLQSLNAQIIDTSPDETFIVCAQFRLHHLNHNASNERNEFLKVLRNMEPQGVILSENNMECCCNSCGNFADGFSRRVEYLWRFLDSTSSAFKGRECDERRVMEGEAAKILTNQREMNEGKEKWFGKMKEAGFIWQVFGEDAIDGGQALLRKYDSNWEMKVEENNTSVGLWWKGQPVSFCSLWKLDGNYQSRFRDQL

SEQ ID NO: 81 - protein, 582 aa, Mucuna pruriens
MEPNPTSDHTLDWFEGSVSFFPLLPPFLDDPYNSSDIQEYHLWDQDITSHYQTDTNTSSPNATNTATSTAPLEPCGSNNLPLSDLPKKRNATDESSLKPSQNHKHKKTKSRPMNDEEHLLEEVSPLNGSQYLEGLVLDSQPEDTPVHPKKKIKSRPMNNEADNGDARGTTTVRKSGGNKKGVAKGVGNNSNNKEGRWAEQLLNPCAAAITGGNLNRVQHLLYVLHELASPTGDANHRLAAYGLKALIHHLSSSPTSSSSGSITFASTEPRFFQKTLLKFYEVSPWFSFPNNIANASILQVLGEDHDNSRTLHILDIGVSHGMQWPTFLEALSRRPGGPPPLVRLTVVTVSSTENDTPFSIGPPGDNFSSRLLGFAQSMNVNLQIKRLDHCPLQTLNAQSVDTSPDEIFIVCAQFRLHHLNHNERSEFLKVLRNMEPKGVILSDNNIECCCNCCGDFATGFSRRVEYLWRFLDSTSLAFKGRESDERRVMEGEAAKALTNQREMNEGKEKWCERMKEVGFVGEVFGEDVIDGGRALLRKYDNNWEMKLEDDNTSVGLWWKGQPVSFCSLWKLDGNDQSSTFTS

SEQ ID NO: 82 - protein, 507 aa, Cajanus cajan
MIMEPNSTSDHTLDWFEGPVSFFPLPPFLDDPYNSSDIQEYQLWDEDITSHYQTDANTNSPNATNIDTSTPLEPCGSNNLPLSDLAKKRSATDESSGAKGVGNNCNNKEGRWAEQLLNPCAAAITGGNVNRVQHLLYVLHELASPTGDANHRLAAHGLKALTQHLSSSTTSVTTSGSITFASTEPRFFQKSLLKFYEVSPWFSFPNNIANASILQVLGEDPNNSRTLHILEIGVSHGMQWPTLLEALSRRPGGPPPLVRLTVVTASSTENNDQNYIDTPFSIGPPGDNFSSSLLGFAQFMNVNLQINRLDNCSLQTLNAQSVDTSPDEIFVVCAQFRLHQLNHHTPDERSEFLKVLRNMEPKGVILSDNNMECCCNCCGDFATGFSRRVEYLWRFLDSTSAAFKGRESDERRVMEGEAAKALTNLRAMNEGKEKWCARMKEVGFVGEVFGEDAIDGGRALLRKYDNNWEMKVEDENASVGLWWKGQPVSFCTLWKLDGNDQSSTFTS

SEQ ID NO: 83 - protein, 542 aa, Glycine max
MIMEPNPTPDHSLDWFEGSVSYFPPFLDYPYNSSDIQEYQLWEQDIASNYQTDTNTSSPNATNIVTITTPLETCDSNNLPLSDLPKKRSATDESSPKPPQNHKHKKIKSKPRNNEADNGDAEATTTTTATVRKSGGNKKGGAKANGNNCNNKDGRWAEQLLNPCAAAITGGNLNRVQHLLYVLHELASPTGDANHRLAAHGLKALTQHLSSSPTSTSSGSITFASAEPRFFQKTLLKFYEVSPWFSFPNNIANASILQVLGEDTDNSRTLHILDIGVSHGMQWPTFLEALSRRAGGPPPLVRLTVVTASSSTENDTPFCIGPPGDNFSSRLLGFAQSMNVNLQINKLDNCPLHSLNAQSVDASPDEIFVVCAQFRLHQLNHNAPDERSKFLTVLRNMEPKGVILSDNNLGCCCNCCGDFATGFSRRVEYLWRFLDSTSSAFKGRESEERRVMEGEAAKALTNQRETNEGKEKWCERMKEAGFVEEVFGEDAIDGGRALLRKYESNWEMKVEDDNRSVGLWWKGQSVSFCSLWKLDGNDQSST

SEQ ID NO: 84 - protein, 543 aa, Glycine max
MIMEPNPTSDHSLDWFEGSVSYFPPLLDYPYDSGDIQDYQLWEQDITSHYQTDTNTSSSPNATNISTTTTPLETCDSNNNLPLSDLPKKRNATDESSPKPPQNHKHKKIKSKPINNEAYTGHAEGTTTTTVRKSGGNKKGGAKANGNNCNNKDGRWAEQLLNPCAAAITGGNLNRVQHLSYVLHELASPTGDANHRLAAHGLKALTQHLSSSPSSGSITFASSEPRFFQKTLLKFYEVSPWFSFPNNIANASILQVLGEDTDNNSRTLHILDIGVSHGMQWPTFLEALSRRPGGPPPLVRLTVVTASSSTENDTPFCIGPPGDNFSSRLLGFAQSMNVNLQINKLDNCPLHTLNAQSVDTSPDEIFVVCAQFRLHQLNHNAPDERSEFLKVLRNMEPKGVILSDNNMGCCCNCCGDFTTGFSRRVEYLWRFLDSTSSAFKGRESDERRVMEGEAAKALTNQRETNEGKEKWCERMKEAGFVGEVFGEDAIDGGRALLRKYDGNWEMKVEDDNTSVGLWWKGQSVSFCSLWKLDGNYKTSTFTS

SEQ ID NO: 85 - protein, 542 aa, Phaseolus vulgaris
MIMEPNPTSDHSLDWFEGSVSFFPLPPFLDDPYNSSDIQEYQLWDQDISSQYQTDANISSPNVTNIATSIPPPEPCGSNNLKLSDLPKKRSSTDDSSLRPPQSHKHKKIKSKPMNNEADSGEAEGTTTVRKAGGNKKGAAKGVANNCNNKEGRWAEQLLNPCAAAITGGNLTRVQHLLYVLHELASPTGDANHRLAAHGLKALTHHLSSSLASTSSGSHTFASTEPRFFQKTLLKFYEVSPWFSFPNNIANASILQVLGEDNDNSRTLHILDIGASHGMQWPTFLEALSRRPGGPPPLVRLTVVTASSTEIDTPFSIGPAGDNFPSRLLGFAQLMNVNLQIKRLDNCPLHTLSAQSVDTSPDEIFVVCAQFRLHQLSHNTSDEKSEFLKVLRNMEPKGVILSDNNMECCCNCCGDFATGFSRRVEYLWRFLDSTSSAFKGRDNDERKVMEGEAAKALINQREMNEGKEKWCERMKEAGFVGEVLGEDAIDGGRALLRKYDSNWEMKLEGDNRSVGLWWKGQPVSFCSLWKLDGNDQSSTFTS

SEQ ID NO: 86 - protein, 544 aa, Vigna unguiculata
MIMEPNPTSDHSLDWFEASVSFFPLPPFLDEPYNSSDIQLWEQDISSQYQTDANTSSPNATNIATSTTPPEPCASNNLPLSDLPKKRSATTDDSSLRPPQNHHKYKKIKSKTMNSEADSGDAEGTTTVRKPGGNKRGTAKGVANNCNNKEGRWAEQLLNPCAAAITGGNLSRVQHLLYVLHELASPTGDANHRLAAHGLKALTLHLSSSLASTSSGSMTFASTEPRFLQKTLLKFYEVSPWFSFPNNIANASILQVLGEDNDNSRTLHILDIGASHGMQWPTFLEALSRRPGGPPPLVRLTVVTASSSEIDTPFSIGPPGDNFSSRLLGFAQLMNVNLQIKRLDNCPLHTLSAQSVDTSPDEIFVVCAQFRLHQLSHNSTDEKSEKSEFLKVLRNMEPKGVILSDNNMECCCNCCGDFATGFSRRVEYLWRFLDSTSSAFKGRDSDERRVMEGEAAKALTNQREMNEGKEKWCERMKEAGFVGEVLGEDAIDGGRALLRKYDSNWEMKVEDDNRSVGLWWKGQPVSFCSLWKLDGNDQSSTFTS

SEQ ID NO: 87 - protein, 539 aa, Vigna angularis
MIMEPNPTSDHSLDWFEGSVSFFPLPPFLDDPYNCSDIQLWDQDISSHYQTDANTSSPNATNIATTTTPPEPCASNNLPLSDLPKKRSATDDSSLGQPQNHKHKKIKSKPLNNEADSGDAEGTTTVRKPGGNKKGAAKGVANNCNNKEGRWAEQLLNPCAAAITGGNLTRVQHLLYVLHELASPTGDANHRLAAHGLKALTHHLSSSLVSTSTGYMTFASTEPRFFQKTLLKFYEVSPWFSFPNNIANASILQVLGEDNDNSRTLHILDIGASHGMQWPTFLEALSRRPGGPPPLVRLTVVTASSTEIDTPFSIGPPGDNFSSRLLGFAQLMNVNLQIKRLDNCPLQTLSAQSVDTSPDEIFVVCAQFRLHQLSHNSTDEKSEFLKVLRNMEPKGVILSDNNMECCCSGCGDFAMGFSRRVEYLWKFLDSTSSAFKGRDSDERRVMEGEAAKALTNQREMNEGKEKWCERMKEAGFVGEVLGEDAIDGGRALLRKYDTNWEMKVEDDNRSVGLWWKGQPVSFCTLWKLDGNDQSSTFTS

SEQ ID NO: 88 - skipped

SEQ ID NO: 89 - protein, 540 aa, Vigna radiata
MIMEPNPTSDHSLDWFEGSVSFFPLPPFLDDPYNCTDIQLWDQDISSHYQTDANTSSPNATNIATSTTPPEPCASNNLPLSDLPKKRSATDDSSLRQPQNHKHKKIKSKPLNNEADSGDAEGTTTVRKPGGNKRGAAKGVANNCNNKEGRWAEQLLNPCAAAITGGNLTRVQHLLYVLHELASPTGDANHRLAAHGLKALTHHLSSSLASTSSGSMTFASTEPRFFQKTLLKFYEVSPWFSFPNNIANASILQVLGEDNDNSRTLHILDIGASHGMQWPTFLEALSRRPGGPPPLVRLTVVTASSTEIDTPFSIGPPGDNFSSRLLGFAQLMNVNLQIKRLDNCPLHTLSAQSVDTSPDEIFVVCAQFRLHQLSHNSTDEKREFLKVVRNMEPKGVILSDNNMECCCSGCGDFAMGFSRRVEYLWKFLDSTSSAFKGRDSDERRVMEGEAAKALTNQREMNEGKEKWCERMKEAGFVGEVLGEDAIDGGRALLRKYDTNWEMKVEDDNTSVGLWWKGQPVSFCTLWKLDANDQSSTFTSS

SEQ ID NO: 90 - skipped

SEQ ID NO: 91 - protein, 548 aa, Setaria italica
MSNERDGQEPAAATSSSASDWLDESIAFLAADLDLGLDAYGWMQASAEAERQGFHSMVTETLPPPATTLPQSGLGPVSTSVAPSPVASPQEFGQPRKRKSPQHSSQRCPVGGGGGRGGPELDRGGTSCSRKPSKKGSARAGDASLDRDARWAEQLLNPCAVAIEAGNLPRAQHLLYVLSELASFSGEPNHRLAAHGLRGLALRLPAAVGQAAAATLKMPPCECPAPAFPGADPRLFRASLIRFNEVSPWFAVPNALANAAIAQAASARGAAAEPRRVHVVDVGVSHGVQWPTLLEALTRVPRGSTPPSVRLAVAGHAATPPAPFSSSPPGYDCSLQLLRYAKTINLDLTIVQAPSLDTLHGILTPGETLVVCLQFRLGHAATDEQAAVLRNIRTLNPELLILAELECGSRSDSSAAIEFAARLENLWMFLDSTAAAFKGRDVDERRVMEAEAGTALAATARRGAAVAGGREAWRARLAAAGFEEAAFGGEAVETAKALLRKYDSGWELVPPSPSAGAAVGLRWKGQPVSFCSLWRPAQAGPEPMWHGA

SEQ ID NO: 92 - protein, 550 aa, Sorghum bicolor
MNNEREEQEPAAATTSDWLDESIAFLAANLDLGFNDYGLLSTASEAQEQHDVGGMIVETLPPTATTLHQPSLNLDTSVASSSPMTSQQELGQPKKRKSPGHSSSQRPHAGGGGRGGGQQEMGEASCVRSKPSKKVNGKGTAANSDREARWAEQLLNPCAAAIEAGNLPRTQHLLYVLGELASFSGEPNHRLAAHGLRALTRRLPHAVGEAAAATVKMPSCECPTPLFSGVDLRLFCASLIRFNEVSPWFAVPNALANSAIAHAASTKGAVTGPRQVHVVDMGVSHGVQWPTLLEALTRVPRGSTPPSVRLTVAGPTATPPVPFSASPPGYDCSPQLLRYAKSIDLDLSIVQAPFLDTLHGTLTPGETLIVCLQFRLGHATADEQAVILRTVRDLNPELMVLTELDVGGGRNVDSAASEFAARLELLWRFLDSTAAAFKGMDADERRVMEVEAGTALAPTARRGATVGGGRESWRARLAAAGFEEAAFAGEAVETAKALLRKYDSRWELVPPSPPAAAAVGLRWKGQPVSFCSLWRPAQASPELMVMGRGA

SEQ ID NO: 93 - protein, 545 aa, Zea mays
MNNERESQEPAAATTSDWLDESIAFLAANLDLGFNDYGWPSASEAQERHDDVRSMIVETLAPTATTLHQPSLNLDISVASSSSPMTSQQEFGQPKKRKSSGNSSSQRPHVGGGGQQEKGGASCARPKPGKKGSGKGAAATLDREARWAEQLLNPCAAAIEAGNLPRTQHLLYVLGELASFSGDPNHRLAAHGLRALTRRLPHATGQAALATVKVPPCECPTSVFSGVDPRLFRASLIRFNEVSPWFAVPNALANSAIAQAASRKKGAVAEPRQVHVVDIGVSHGVQWPTLLEALTRVPRGSTPPSVRLTLVGPTATPPVPFSASPPGYDCSPQLLRYAKSIDLDLAIVQAPCLDTLRGTLTPGETLVVCLQFRLGLATADDQAAIFRKVRDLNPELMVFTELDGGRRNDDSATSEFAARLELLWRFLDSTAAAFKGMDADERRVMEAEAGTALALTPRCGATVDGGREAWRARLAAAGFEEAAFGGEAVETAKALLRKYDGGWELVLPSPSAAAAVGLRWEGQPVSFSSMWRPAQASPVLIGPCA

SEQ ID NO: 94 - protein, 523 aa, Oryza sativa
MSYHEEERHGGNGLDWFEESMSSLLAADVDLAGGGGDAGGGGYAWWWAASPAAQQDDIGSVVAQTLSPPSTAAPAAASPSIASPAASSPSDVPSSSSKKRKSPAHRAPGHTGGKKGGGGKGGGGGSDRDMRWAEQLLNPCAVAVEAGNLSRVQHLFYVLGELESFSGDANHRLAAHGLRALARWLPAAVGPAAAAAVRVPPCSERPTTAFAAAEPRLFRASLIRFHEVSPWFALPNALANAAIAQASTCGAAGATPRPLHVVDLGVSHGVQWPTLLESLTRQPGGRAPPSVRLTVVGPGATATSPVAPFSASPPGYDFSPHLLRYAKSINLDLRISRAATLDDAVPGDDGEALVVCLQFRLGHAAAEERREVLRKARGLNPELVVLSELDSGVGVVGGDGGSAAGEFAARLELLWRFLESTSAAFKGKDVEERRLLEAEAGAILAAADVAAAGEGREGWRERMAAAGFEEAPFGAEAVESARSLLRKYDSGWEMSAPSPAAAAVALRWKGQPVSFCSLWRPAA

SEQ ID NO: 95 - protein, 528 aa, Setaria italica
MKPMSCHDQEHPAELAAATSSTGFDWLEDSLSFLAADVDIAGGYGWWCNPAAAQQDDIGSVVAHTLSPPAPLPTSSSPLAHASPSIASPVVSSPSEPSSKKRKSPAHRASGHSSSNQRRRAERDRPGGGGNGKKGGSKGGGAGSDRDTRWAEQLLNPCAAAVEAGNLSRAQHLFYVLGELASFSGDANHRLAAHGLHALSRRLPAAVGPAAAASVRVPPCERPAPAFAGAEPRLFRASLIRFHEVSPWFALPNALANAAIARAAAAGAPRPLHVVDLGVSHGVQWPTLLESLTRMPGGRAPPSVRLTVVAAGTPPAPFSASPPGYDFSPHLLRYAKSINLPLAISRAACLDSVHSLAAPGEALVVCLQFRLGHTTADERARILNKVRGLNPELVVLSEVDGGGVDGTAAGGFAARLELLWRFLESTSAAFKGRDGEERRLLEAEAGTSVAAAEVAGEGRDAWRERMAAAGFEEAAFGDEAVESARSLLRKYDGGWEMSAPAGSAGAVALRWKAQPVSFCSLWRPACSA

SEQ ID NO: 96 - protein, 348 aa, Zea mays
MKPMSCHEQEHPELAATTTNSGFDWLEDPISFLTADVDIAAGGYGWWSDPAAAQQDGIGSVVAQTLSPPAPLLAHTSPSIASPVVSEPSSKKRKSPAHRASASTGSNQRRRADQDRPGAGSGGGGSKRSGSKGGGAGSDRDTRWAEQLLNPCAAAVEAGNLSRVQHLFYWPTLLESLTRLPGGRAPPSVRLTVAGAPPAPFSASPPGYDFSPHLLRYAKSIDLRLAISRAASLDSVHGLASSPSGEALVVCLQFRLGHAGADERTEILRKVRGLNPELVVVSELDGGGDGTAAGEFTARLELLWRFLESTKYDGGWEMSASGTAGAVALRWKGQPVSFCSLWRPACSG

SEQ ID NO: 97 - protein, 555 aa, Sorghum bicolor
MSMHISSSPCKIACMKPMSCHEQEHPELAATTTNSSAFDWLEDSISFLTADVDIAAGYGWWSDPAAVQQDDIGSVVAQTLSPPAPLLTTTSTSPPLAHTSPSIASPAVSSPSEPSSTKKRKSPAHRASAHSGSNQRRRADQDRPAGAGGGGGSKKGGSKGGGAGSDRDTRWAEQLLNPCAAAVEAGNLSRVQHLFYVLGELASFSGDANHRLAAHGLHALARRLPAAVGPAAAATVRVPPCECPTPAFAGAEPRLFRASLIRFHEVSPWFALPNALANAAIAQAASRGGPAAEPRPLHVVDLGVSHGVQWPTLLESLTRQPGGRAPPSVRLTVAGAAATPPAPFSASPPGYDFSPHLIRYAKSINLQLAVSRAASLDSVQHGFASPPGGGEALVVCLQFRLGHASADERTEILRKVRGLNPELVVVSELDGGGDGTAAGEFTARLELLWRFLESTSAAFKGRDGDERRLLEAEAGTSVASEAAGAGKEAWRERMAAAGFEESAFGDEAVESAKSLLRKYDGGWEMSASGAAGAVALRWKGQPVSFCSLWRPACSG

SEQ ID NO: 98 - protein, 307 aa, Zea mays
MPEQHAELAAATTNSGFDCLEDPISFLTADVDAAGCGGYGWWSDDPAAAQQDDIGSVVAQTLSPPAAPLLTTNPPLAHTSPSIASPAVSEPSSKKRKSPAHRASAHSGSNQRRRAEQADRPGAGGGKKGGGAGSDRDTRWAEQLLNPCAAAVEAGNLTRVQHLFYWPTLLESLTRLPGGRAPPSVRLTVAAAPPAPFSASPPGYDFSPHLLRYAKSISLQLAISRAASLDSVRGLASPSASGEEALVVCLQFRLGHASADERTEILRKVRGLDPELVVVSELDSGGDGTAAGEFTARLELLWRFLES

SEQ ID NO: 99 - protein, 526 aa, Brachypodium distachyon
MKAMDYHEPDEQELTTAVTAIADGGGLDWLEDSISLLSADGDLSGSYGWWCDPPLLPAQQDDIGIVVAQTLPPPAALTTTGSPPTSIASPAPASSKKRKSSPASGHSGGGSQRRRAEQERERPAGGGGKKKGGGSDCREARWAEQLLSPCAVAVEARNLSRVQHLFYVLGELASFSSGDANHRLAAYGLRALSLRLPAAVGPAAAAAVRVPALGAECPSSFAAAEPRVFRASLIRFHEVSPWFALPNALANAAIAQQLLQAPGRPLSLVDVGVSHGVQWPTLLESLTRLPAGRAPPSVRLTVVSAAAATRAAPFSASPPGYDFAPHLLRYAKSINLDLHIARAGDLSAQLGEEEALVVVCLQFRLGHVAPEERTEVLRKVRDLKPDLVVLSELDVVVGGGSAGAAGEFSARLELLWRFLESTSAAFKGRDGEDRRLMEAEAGAPAGMITAPASGEGREAWRDRMRAAGFQEAAFGGEAVESARSLLRKYDSGWEMAGAASGAAAVALRWKGQPVSFCSLWRPAPPP

SEQ ID NO: 100 - protein, 263 aa, Hordeum vulgare
SGNQRRRTEQDRPGGGKKGGGAGSDRDARWAEQLLGPCAVAVEARNLSRVQHLFYVLGELAAFSGDANHRLAAYGLRALSLRLPAAVGPAAAAAVRVPAACECPTPSFAGAEPRLFRASLIKFHEVSPWFTLPNTLANAAISQLASAAPRPLHLVDIGVSHGVQWPTLLESLTRMAAGRAPPSVRLTVVATPPVPFSASPPGYDFSPHLLRYAKSIKLDLEIGRAASLDSAHGFCTAPDEALVVCLQFRLGHVTAEERTDIIR

SEQ ID NO: 101 - protein, 142 aa, Hordeum vulgare
  VARIANT 1: Xaa = Any Amino Acid
XDLKPQLVVLSELDVGGNGSAAGEFTARLELLWRFLESTHAAFKGRDGEDRRLLEAEAGTGVAVAAAREAMGREGWRDRMTAAGFDQVAFGGEAVESARSLLRKYDNGWEMSTAAAATGGGGAVALRWKGQPVSFCSLWRPA

SEQ ID NO: 102 - protein, 481 aa, Hordeum vulgare
  VARIANT 1, 2, 3, 4, 5, 6, 7, 8, 9, 395, 396: Xaa = Any Amino Acid
XXXXXXXXXTAVEPHRPHTIAEPHRPAAQPNPIAPPLALAHAHPSPSIASPAASEPSPGKRKSPVRVGSGSGQGSSNQRRRTEQDRPGGGKKGGRAGSDRDARWAEQLLGPCAVAFEARNLSRVQHLFYVLGELAAFSRHPKHRLAAYGLRALSLRLPTAVGPAAAAAVRVPAACECPTPSIAGAEPRLFRASLVKFHEVSPWFTLLNTLANAAISQLASAAPRPLHLVDIGVSHGVQLPTLLESLTCMAAGRAPPSVRLTVVATPPVPFSASPPGYDFSSHLLRYAKSIKLDLEIGRATSLDSAHGFYTAPNKARVVCLQFRLGHVTAEERMDIIRRVKDLKPQRVVLSGLDVGGNGSVAGESTARLELLWRFLESTHEAFKGRDGKDRRLLEXXAGTAVAVAAAREATGRKGWRDRMTAAGFDQVVFGGEVVESARSLLRKYDNGWEMSTVAAAKGGGGAVALRWKGQPVSFCSLWRPA

SEQ ID NO: 103 - protein, 451 aa, Hordeum vulgare
TNCRYVYTSPLFLRRGRTCLPECRRCNRACACAAMQAGGRGKATTNKQGWIDAFSSSEMGPWASRSGVGPGREVGGAAAGSLRRRRRGAQPVPRATPLLRARRARGLLRRRQPQACRVRAASALASPPCRSWPRGRRGREGAGRMRVPDAVARRAEPRMFRASLIKFHEVSPWFTLPNTLANAAISQLASAAPRPLHLVDIDVSHEVQWPTLLESLTRMAAGRAPPFVRLTVVATPPVPFSASPPGYDFSPHLLRYAKSIKLDFEIGRAASLDSAHGFCTAPDEALVVCLQFRLGHVTAEERTYIIRRVKDLKPQLMVLSELDVWGNGSTAGEFTARLELLWRFLESTHAAFKGRDGEDRRLLEAEAGSAVAVAAAREAVGREGWRDRMTAAGFDQVAFGGEAVESARSLLRKYDNGWEMSTTAAATGGGGAVALRWKGQPVSFCSLWWRA

SEQ ID NO: 104 - protein, 377 aa, Hordeum vulgare
APPPCAFTKLTKRPSLHLRRRLRVQLPLPVRLAVSGSGHGSRNQRRRTEQDRPGGGKKGGGAGSDRDARWAEQLLGPCAVAVEARNLSHVQHLFYVLGELAAFSGDANHRLAAYGLRALSLRLPAAVGPAAAAAVRVPAACECPTPSFAGTEPRLFHASLIKFHEVSPWFTLPNTLANAAISQLASAAPRPLHLIDIGVSHGVQWPTLLESLTRMAAGRAPLSVRLTVVATPPVPFSASPPGYDFSPHLLPYAKSIKLDLEIGRAASLDSAHGFCTAPDEALVVCLQFRLGHVTAEERTDIIRRVKDLKPQLVVLSELDVGGNDSAAGEFTARLELLWRFLESTHAAFKGRDGEDRRLLEAEAGTAVAVAAAREAVG

SEQ ID NO: 105 - protein, 230 aa, Hordeum vulgare
MLHLLLQRKTVTPPRKKEPIKYRNLRTMHLRRGLRVQLPLPVRLAVSGSGHGSSNQRHRTEQDRPGGGKKGGGAGSDRDARWAEQLLGPCAVAVEARNLSRVQHLFYVGELAAFSGDANHRLAAYGLRALSLRLPAAVGPAAVRVPAACECPTPSFAAAEPRLFRASLIKFHEVCSWFTLPNTLANAAISQLASPALHLIDIGVSHGVQWPTLLEPSPAWPPDGRRRPSG

SEQ ID NO: 106 - protein, 426 aa, Hordeum vulgare
LRRRLRVQLPLPVRLALSGSGHGSSNQRRRIEQDRPGGGAGSDRDARWAEQLPGPCAVAVEARNLSRVQHLFYVLGELAAFSGDANHRLAAYGLRALSLRLPAAVGPAAAAAVRVPAACECLTPSFAGAEPRLFRASLIKFHEVSSWFMLPNTLANAAISQLASPALHLIDIGVSHGVRWPTLLESLTRMAAGRAPPSVRLTVVATPPVPFSASPPGYDFSPHLLRYAKSIKLDLEIGRAASLDSAHGFCTAPDEALVVCLQFLLGHVTAEERTDIIRRVKDLKPQLVVLSELDVGGNGSAAGEFTARLELLWQFLESTHATFKGRDGKDRRFLEAEAGTAVAVAAAREAVGREGWRDRMTATGFEQVAFGGEAVESARSLLRKYDNGWESPRRRRRREAAAPWRCGGKGSRCPSARCGRRRSSGS

SEQ ID NO: 107 - protein, 647 aa, Physcomitrella patens
MFGNDVIGGGQQVMDLSGGNPIQCGAAQPWVNPYNNPEPEYVYLVSPQNSHTLSENGYSNLSCGPVPQPNYMVRPDSNFLPQLNPVQQFSAPHMDYRYLPPAQPPVSHEPYGTLSDNNLQQYDNVWQSLESDFLAQTSVQYNDVPGDNNMIEVVHGFHDPPAHISISVSNEVPLTSRPVADHRAWTMPSHPIPGVAESSGSVPAEYGNTSSPTSTRQSQEFNPSHGFAGQGQVPSDTVSTTGTGGNHAAAQRSSRPKSNFEDQMQTSHQQYRKVLDDGEVACASGGSSYNESDPTVDNDLSTLMAPGRSGLQSLGESSWAVQLLNLCAAAIESQNVSRTQHLMWVLNDFASVVGDANQRIAAYGHRALFCRITGSLEAAKTYLRPKHYDQELSLGPKMVHRALVKFHEHVPWHQNCYSIMSQTLLEVCAGKSRLHIIDIGAGKGIEWPIFIDALVSRSGGPPSILRMTMIRDLQREEHNLRSQLNSESSDFMTRLVKFPGLLGLHVEVNMVRKALECVTQELLAVICQFRLHRLSEEPDTNCLPPRLSPRDKFLDFLFQLNPHVFIQSDNNCDHCSQDFLTRFRNASAFWWNCFESIVFDYNGRDPDGRQINMASLQWRNPPTTFTSVWKTPSTCLKTSCKYSKLHS

SEQ ID NO: 108 - protein, 852 aa, Physcomitrella patens
MRTSRRADGLPQAPCPSSTMQRFAVGHSSHPGDGSVYGSASSNLAMFAKDMGGAGQHIMDMSRGNLDRRGAAQTWVNPYSNPEFEYVYLGSPQTSQDSQTPLILDPGMSSVSSGSQVLQPPTGNVHYNASYGRTSQSKYAVQPSSNFQGHLHPAQQFSAPPMHRHKAPEMHTPFSQEFYNVQDEIDMQSYEDIWRNLESDFLAQTSAQYDATPGDINMVDAVYNVSQSTPGIPFPVPNQTQPVSRPIADQKTWNMLSNSVQNEAESSSNVRTRYGNASSSTRHPFGFNPPRHFAEQAQPHQRSEVAQNRDLSFHQSVMETRPDFMDMVMDDSVSDGISITGSSDNQLRHAQSPNYGFGSHGYAGTASNFGERQHSAVQQSFQPENNSREQMQTNHQYNRFPEHREASFSSGGDLYNETKSGVESDFSTLMAPGQSGLRSLGESRWAEQLLNLCAAAIASKNISRMQHLMWVLNDLASVVGDANQRYAAYGLRALFCRITGRMEAAKTYLRPRHYDQEQSYGPKMVHRALVKFHEHVPWHQNCYSVASQTLLEVCAGKSRLHIIDIGAGKGIEWPIFIDALVSRSGGPPSILRMTMIRDLQREEPNLRTRGGSEAADFMTRLVKFASLLGLHVEVNMVRKPLECVTREDLKLRDGEILAVVCQFRLHRLSEELDYQSSPPDLSPRDKFLDFLFTLDPHIFIQSDNDSDHCSQDFLTRFQNAVSFWWRCFESIDVGYNGRDPDERQIIEYEGAMMLLNMVACEGIARIERNESYPQWARRIKRAGFMPRELSEETKKVSQNLVANHSEFWETAFIESNMVSLLWRKQPTTFTSVWKSSSCTNPKHSCKCSKLHN

SEQ ID NO: 109 - protein, 850 aa, Physcomitrella patens
MKPEAPVPLTSQGHRAGGNEHRHLASNSMTMFGSNAWDRATQHPTDLVGDNLHQGGATRHWVSPYSDPQLEYVYLGTPHQGSPQTSQVASPQRWPMPDATLNPSLAPPASNNVQYFQPTSGHPTSGQPTSGHAYIDHNGYNAAPTGTAQPSYTMPSSHFQLSQFQTVQRFGGVLSQETYEGPAVSELQYDNIWSISESNFLAQRSPQFNVAPGDIDMVEGYGLNSSANMQTPMASQLQQGGSVGNSTGNWTMLSQSPVLDDVGSSSSGQGAYNSTITGQTSMGGDNQGFLHDHHHSEGSRDCDRALFQLGGMPLPNVGYGETVMNPRLDYMNIVMEDTVSDGVSSTSTVDNRSSRDARAQTPYGHDQSGQGSSPLDSSVREQFQHNHQQRLEHREAYNTSARSDYNGQATAMDNDFTQLIASGFSGIRHLGEPRWAMQLLNLCAAAIASRNISRTQHLMWVLNDLASVVGDANQRFAAYGLRALFCRITGRMEAASTFLRPRHYDQEISFGPKTVHRALVKFHEYVPWHQICYTAACQILMEVCAGKARLHLIDIGAGKGIEWPIFIDALVSRPGGPPAILKITMIRDQRREELNMRTAKSVNSEAADLMTRLVKFAGLVGLHVEVNVVTKALECVTREDLKIRDGETLAAVCQFRIHRLSEEVPDRATKSNPTSRPLLSPRDDFFDFLFSLKPDVFIMSDNDSDHCSHDFLTRFQNAISFWWRCYESMDIGYNGRDSEERQIIEYEGGMMVLNMVACEGFARIERNESYPQWQRRITRAGFVPQNLSDETKKVCQTLISNHSEFWELSFTDSNVVNLLWRKQPTTFTSVWKMPQSYSSSSSCQSTLIHN

SEQ ID NO: 110 - protein, 725 aa, Physcomitrella patens
MATMEKEESANIYIDHEDLFRVPPSSNCDQSILSMTNNWGDERLTQWFDGAIDVEGTPGLGLDLNLAVEDEDVQDMAYSDRLWSGIDEPIVLSEGRTRVNYYLAASTVELDVPEPNDSISAADMLRLPIIHGSYCAPGANSLNKYTAWSEMPSDAALESVSDMHYGSNSDGSTRPTQGLEDLFDAEEDHQLEIMSNDADSIELTMEILSDGVMSVSLEEESDDDSLQELIAYRRSSSSSRHEFEYELMQSPIRPGTGFTARKKMMHEWVNQGESTFIVPDNIKGADPEEKITIGNGPHDILQPREMLSQPGDSRWAEQLLNLCAGAIASKNIGRTQHLMWVLNELASFTGDGNQRLAAYGLKALFCRITGGKEASATYIRPFHHQEKTLGPKAVHRALVTFHEFSAWHQVAYTVTNETLLEVFAGKSHLHIVDVGIIKGLQWPILIDALSNRPGGPPTKLRITTIRHQNATAKTTGSKQVDAESADFMSRLVTFAKVLGLHCELNMYVGPLENIKKEDLKLEDGEVLAVCCQFRLHRLSNLVPKSSRHSPTPHLSPRDAFLDFLSSLKPSVLVVSENDADMLSENFLTRFKEIINFWWTFFDSTHIAFNGREPEAQQIVEYEGSMIMLNGIACEGVERIERNDRQDNWMSRIRRAGFVPMCISEDTKKTVQVLLQNTASVHWSVRYSQNTNCVNMSWKDQPVNFTSLWKAPSCSRKLCKCNMLHD

SEQ ID NO: 111 - protein, 464 aa, Sphagnum fallax
MMQDAGSTGRRPVRGASSSDERVNSSARIGEQELRQVPEEDELNWAEQLLNLCATAIASNNLARTKHLMSVLNDLGSLTGDANQRLAAYGLRSLYCRVTCRKDSAVASYLGPLRLQVRRLGPKTVHRTLIKFHELSPWHQLIHTVSNQTLLQVFEGHTHLHVIDIGVSQGLQWPLLIDSLVSRDSGPPPAAGGEESDPSFEDNLNRLVKFAGLLGLNVELSILTEPLESVTRQQLQLREGEVLAICAQFRLHRIIEDERDSGIIFAPPHTSDHATSRLRHELSPRDGFLNFLFQLQPHVLILGENDIDHLSHDFLTRFKSVMSPWWKFFDSLHIAFQGQDVDERQILEDEVGRMMLNNVACEGAVRIERCEPQISWARRLQMASFEPLNLTAETLEAVHLLLHKSGAHWGIAVAANCVTLLWKQQATTFCSVWKSHTSQQHGDASLLLICSQAQSAPPMFSLPF

SEQ ID NO: 112 - protein, 510 aa, Arabidopsis thaliana
MLLEETEPPNQTLDHVLSWLEDSVSLSPLPGFDDSYLLHEFDGSQTWEWDQTQDPEHGFIQSYSQDLSAAYVGCEATNLEVVTEAPSIDLDLPPEIQQPNDQSRKRSHDGFLEAQQVKKSARSKRKAIKSSEKSSKDGNKEGRWAEKLLNPCALAITASNSSRVQHYLCVLSELASSSGDANRRLAAFGLRALQHHLSSSSVSSSFWPVFTFASAEVKMFQKTLLKFYEVSPWFALPNNMANSAILQILAQDPKDKKDLHIIDIGVSHGMQWPTLLEALSCRLEGPPPRVRITVISDLTADIPFSVGPPGYNYGSQLLGFARSLKINLQISVLDKLQLIDTSPHENLIVCAQFRLHHLKHSINDERGETLKAVRSLRPKGVVLCENNGECSSSADFAAGFSKKLEYVWKFLDSTSSGFKEENSEERKLMEGEATKVLMNAGDMNEGKEKWYERMREAGFFVEAFEEDAVDGAKSLLRKYDNNWEIRMEDGDTFAGLMWKGEAVSFCSLWK

SEQ ID NO: 113 - protein, 267 aa, Solanum lycopersicum
MTIDETTSDPISEWLDSPLSYFPSLLDDESYSIDDLLDESYSLDDIYEDSWWAPNESINQEIHINNNNDNSLPCFDTSFPVTTASTVSLEPVISSHLPPLDSSKKRKGNDSGYNPKASRKNQNRRINDADTRRTTGHKKATHKSSTGNNGNNREGRWAEQLLNPCAAAITAGNLNRVQHLLYVLRELSSLNGDANHRLAARGLQALTYYLSTPCPTSLSSASAATFASTNPKFFKNSLINFNEISPWFRIPNSIFLMVFNGQHCSRS

SEQ ID NO: 114 - protein, 542 aa, Solanum lycopersicum
MAIEEPEPNSNSDPISEWLASTLSDVPSFFHEPYSYADDLNFYADPWWVPDQEDQIVNHNIIIDNTCNSFNISSPVNTAINNIPLEPIILDHPQPVDLSKKRKKSDQNPKASKKNHKLQINEAAHAPTIVDQEGVQLKKSIGPKRVTTGNNSNNKEGRWAEHLLNPCAAAITVGNMNRVQHLLYVLHELASFTGDANHRLAAHGLRALTHHLSSPGSSSASSGTIGVTNFSSANHKFFRDSLINFIDVSPWFRIPNNIANSSVLQIIGQQDRLKNLHILDIGVSHGFQWPTLLEELTRRSGGPPPLVRLTVITPTTENGELTGTPFVIGPPGYDFSSQLLAYAKAININLQINRLDNFPLQNLNSQIINSSSDETLVICAQFRLHNLNHTIPDDRTDLLKILKSLDPKGLVLSENNTECSCNSCGDFATTFSRRVEYLWRFLDSTSVAYKGRESEERRMMEGEAAKALTNMGEMNERKEKWCERMRSAGFVKAVFGEDAIDGARALLRKYDSNWEIRVEEKDGCVDLWWKGQPISFCSLWKI

SEQ ID NO: 115 - protein, 582 aa, Theobroma cacao
MIKQLYISQPFSLFTFFLCFKHSFQSTIMTLEEAEPNPTPDHILDWLEDSVSFLPSFLDDPYSTGEINSYQWWDQDQGIGQDLINIGATAIDSPITAAAAVANTTNGSLIQSGSSFPNPGLPPNSSKKRKPSDDQVPRAAQNRQQKKNQSSKINENEKGKAGLEEVVANKRSAGNKKNSNKSSGNNCNNGNNKEGRWAEQLLNPCATAITAGNLTRVQHLLYVLNELASSTGDSNHRLADHGLRALTHHLSSSSASAGPVTFASTEPKFFQRSLLKFYEVSPWFAFPNNVANASILQILAQEPDKTRNLHILDIGVSHGVQWPTLLEALTRRSGGPPPLVRITVVAATAEKSQIMDTPFSIGPPDHDFYSRLPGFAKSMNISLQINRLENHPLQNLNTKIIDNSPGETLIVCAQFRLHHLNHNTPDQRTEFLKVLRSLEPKGVILSENNMDCSCSNCGDFTTGFSRRVEYLWKFLDSTSSAFKGRESEERRVMEGEAAKALTNQGEMNEGKEKWCERMRGVGFVGEVFGEDAIDGARALLRKYDSNWEMRVEEKNGCVGLWWRGQPVSFCSLWKLDIKVEES

SEQ ID NO: 116 - protein, 561 aa, Citrus sinensis
MTIIEEPEPNPTADHILDWLEESVSFLPSFLDDPYNANGIDDYQWWNQGQDMAPEQLIGNTGASSAAAPVNNTEATVNVSTISVRPTDSVVPGPPAPADSSKKRRNADDPRTRSSQSHHQRKNQGRRISETEEGNEEGVIVKRSVGNKKNTNKSTGNNGNNGNSKEGRWAEQLLNPCAAAITAGNLTRVQHLLYVLHELASPTGDANHRLAAHGLRALTHHLSSLSSSSTTTTSTGPLTFSSTEPRFFQKSLLNFYDKSPWFAFPNNIANSSILQILAQDRHNQVQNLHILDIGVSHGVQWPTLLEALTRRSGGPPPLVRLTIIAPTAENDQNAETPFSVGPPGDNYSLQLLGFAKSMNINLQINRLESHPLQDLSSQMVSTSPEETLIVCTQFRLHHLNHSTPDERTEFLRVLRSLEPKGVILSENNMDCSCGNCGDFATGFARRVEYLWRFLDSTSAAFKGRESEERRVMEGEAAKALTNRAEMNEGKDKWCDRMRGVGFVGDVFGEDAIDGGRALLRKYDNSWETRVEERDGCIELWWKGQPVSFCSLWKLNVKVEDS

SEQ ID NO: 117 - protein, 548 aa, Citrus clementina
MTIIEEPEPNPTADHILDWLEESVSFLPSFLDDPYNANGIDDYQWWNQGQDMAPEQLIGNTGASSAAAPVNNTEATVNVSTISVRPTDSVVPGPPAPADSSKKRRNADDPRTRSSQSHHQRKNQGRRISETEEGNEEGVIVKRSVGNKKNTNKSTGNNGNNGNSKEGRWAEQLLNPCAAAITAGNLTRVQHLLYVLHELASPTGDANHRLAAHGLRALTHHLSSLSSSSTTTTSTGPLTFSSTEPRFFQKSLLNFYDKSPWFAFPNNIANSSILQILAQDRHNQVQNLHILDIGVSHGVQWPTLLEALTRRSGGPPPLVRLTIIAPTAENDQNEETPFSVGPPGDNYSLQLLGFAKSMNINLQINRLESHPLQDLSAQMVSTYPEETLIVCTQFRLHHLNHSTPDERTEFLRVLKSLEPKGVILSENNMDCSCGNCGDFATGFARRVEYLWRFLDSTSAALKAGRAKKGGAEMNEGKDKWCDRMRGVGFVGEVFGEDAIDGGRALLRKYDNSWETRVDERDGCIELWWKGQPVSFCSLWKLDVKVEDS

SEQ ID NO: 118 - protein, 543 aa, Manihot esculenta
MTIEEPEPNLISDHILDWLEDSASFLPSFFDDPSNYNSGDVNGCQWWNQTEEICQGLSSTTNTTLNAPSDPTSSNHQQPSNSSRKRGATGDPVPKTSQNHHQGKKQNHRIRISNEDQDGEQVIEVVAGKRSYRKNKGNSKSTGNNGNNGNNKEGRWAEDLLNPCAAAITTGNFSRVQHFLYVLHELASSAGDANHRLAFFGLQALTHHLSSSTTSASVGPISFTSIEPKFFQRSLLKFYEISPWFSFPNNIANSSILQILAQELDHKQSLHILDIGVSHGVQWPTLLEALTRRPGGPPPLVRITVVTATVENDQNTDTPFSVGPPGDNFPPRLLNFAKSMNINLQINRLDNIPLQKLNGQIINTNPEEILIVCAQFRLHHLNHNNPDERTEFLRFLRDMEPKGVVLSENNADCSCNSCGDFATGFSRRVDYLWKFLDSTSSAFKGRDSEERRVMEGEAAKALTNRGEMNEGKERWCERMRRVGFVGEVFGEDAIDGGRALLRKYDSNWEMKIEEKDECVGLWWKGQPVSFCSLWKLDMNMKGK

SEQ ID NO: 119 - protein, 549 aa, Manihot esculenta
MTLEEPEPNHISDHILDWLEDSASFLPSFLDDPYSSSDIYSYQWWNQTEEICQDPINNNASLSSSTSTAVNADSTSLIEASNPTTSNHQQLSNLSRKREAADDPLPQTSHHHQRKKQNHRISNEDQDGEQAVEVVAGKKSNGNKKINSKNAGNNGNNREGRWAEHLLNPCAAAITIGNLSRVQHLLYVLHELASSTGDANHRLAFYGLRALNHHLSSSTTSASIGPISFASTEPKFFQRSLIKFYEVSPWFAFPNNIANSSILQILAQELDHKRNLHILDIGVSHGVQWPTLLEALSRRQGGPPPLVRITVVTATVENDQNTETPFSVGPPGDNFSTRLLSFAKCMNINLQINRLDNHPLQNLNGQVMNTDPEETLIVCAQFRLHHLNHNTPDERTEFLRILRGLQPKGVILSENNTDCSCNSCGDFATGFSRRVDYLWKFLDSTSSAFKGRESEERRLMEGEAAKALTNRGEMNEGKEKWCERMRRVGFVSEVFGEDAIDGGRALLRKYDSNWEMRIEETDGCIGLRWKGLPVSFCSLWKLDLKGNDS

SEQ ID NO: 120 - protein, 548 aa, Ricinus communis
MTIGEPEPNHISDHILDWLEDSVSFLPSFLDDPYNSGGISNYQWWNQTEGICQDPINSNTSLSSSSTITANTNTTSPLATNDHTIDHQPPSNSTSKREAPDDPVPKASQNHHQRKKQNTRISNEGDQGVEVMIGKRSNGNKKSASKGAANNANSGNNKEGRWAEDLLNPCAAAVSTGNLSRVQHLLYVLHELASSTGDANHRLAFYGLQALTHHLSSSRTSASIGSVSFTSIDPKFFQRSLLKFYEVSPWFAFPNNIANSSILQVLAQELDHKRNLHILDIGVSHGVQWPTLLEALTRRSGGPPPLVRITVITATVESDQNTETPFSVGPPGDNFSSRLLNFAKSLNINLQINRLDNHPLQSLNAQVINTNPEDTLVVCAQFRLHHLNHNNPDERTEFLKVLRSLEPKGVILSENNTDRCQICGDFATGFSRRVDYLWKFLDSTSSAFKGRESEERRVMEGEAAKALINCGEMNDGKEKWCERMRDSGFVGEVFGEDTIDGARALLRKYDSNWEMRTEEKDGCVGLWWKGQPVSFCSLWRLDMKGNDS

SEQ ID NO: 121 - protein, 556 aa, Populus trichocarpa
MTIEESEPSHTSDHVLDWLEDSVSFVPSFFDDPYSTADTNPYQWWDQAEEFYQDLVNTNASLSSSITTSTTTNINTTSLVPPITPTLSNHPQSTTSNKKRKDPEDPVTKTSQNHHQRKNPNNWINKKQQDGEAVVVVKKSNGNKKTTNKGTGINGNNGNNKEGRWAEQLLNPCAAAIPIGNMSRVQHLLYVLHELASLTGDANHRLAAYGLRALTHHLSSSSTLSSASTGTITFASTEPKFFQKSLLKFYEVSPWFAFPHNIANASILQVLAQEQDPRRNLHVLDIGVSHGVQWPTLLEALTRRPGGPPPLVRITVITAASENDQTTETPFSIGPPGDNFSSRLLGFAKSMNINLQIKRLDNHSLQKLSGRIIDTKPDEALIVCAQFRLHHLNHNTPDERTEFLRVLRRLEPKGVILTENNMDCSCNSCGDFATGFSRRVEYLWRFLDSTSSAFKGRESVERRMMEGEAAKALTNRGEMNEGKEKWCERMRGVGFVGELFGEDAIDGARALLRKYDSNWEMRGEGKDGCVGLWWKGQPVSFCSLWKLDMKGSESKL

SEQ ID NO: 122 - protein, 562 aa, Populus trichocarpa
MTIEGSEPNQASDHILDWLEDSVSFLPSFLDDPYNAADIDPYQWWEQAEEICQDLANTNTNTNTSLSSSTTTSTITNINTTSLISPNNPTISNHPPTSTSNKKRKDPEDLVPKTSQNHNQRRNLNHRINKEDQDGEAVVGEVVAVKKSNGNKKSTNKSTGNNSNNGNKKEGRWAEQLLNPCAAAITIGNLSRVQHLLYVLHELASPTGDANHRLAAHGLRALTHHLSSSSTVSSASIGTVTFASTEPKFFQKALLKFYEVSPWFAFPNNIANASILQVLGQEQDPTRILHILDIGVSHGVQWPTLLEALTRRPGGPPPLVRITVITATTENDQSTEPPFSIGPPGDNFPSRLLGFAKFMNINLEIKRLDGYPLQKLSGRIIDAKPEEALIVCAQFRLHHLNHNTPDERTEFFRVLRRLEPKGVILSENNMDCSCNSCGDFATGFSRRVQYLWRFLDSTSSAFKGRESEERRMMEGEGSKALTNRGEMNEGIDKWCERMQGVGFVGEMFGEDAIDGARALLRKYDGNWEMRTGGKDGCVGLWWKGQPVSFCSLWKLDMKGSDS

SEQ ID NO: 123 - protein, 548 aa, Prunus persica
MTTQEPEPNSTSDHILDWLEDSVTFFPTFLDNPYHSNDINGLQWWDESHDLIHSNTTSTSLNNPISIALPTTTRPQNPTNLNHQSPSDSSKKRKVSDDQHIDQKNHVRPISLAGQGDQLVDEVVVPVKRTNGNRKGTAKTTGNNCNNGNSKEGRWAEQLLNPCALAITGGNLTRVQHLLYVLHELASLTGDANHRLAAHGLRALTQHLSSSGPNGSASAPPVTFASTEPRFFQKSLLKFYEVSPWFAFPNNIANSSILQLFAEESDRTRNLHIVDVGVSHGMQWPTLLEALTRRPGGPPPLVKITVVSAAANTENNQNRETPFSIGPPGDNFSFSLLGFAKSMNINLQINRLDNQPLQNLNAQVIDTSNDEMLIVCVQFRLHNLNHNTPDERTEFLKALRNMEPKGVILSENNMECSCNNCGDFATGFSRQVEYLWRFLDSTSSAFKGRESDERRVMEGEAAKALTNRGEMNEGKEKWCERMRGVGFVGQVFGEDAIDGGRALLRKYDSNWEMRVDEKDGCAGLWWKGQPVSFCSLWKTDVKVMVTKL

SEQ ID NO: 124 - protein, 655 aa, Malus x domestica
QSRARALVERVFLGPRIVGSLAHIYRAHGEVGHSWRERLGAVGFKPIPISFANHCQAKLLLGLFNDGYRVEEVTNHRLVLGWKSRCLLSASIWTSPLESDVVNMTTEQPEPNSTSDHILDWLEDSVTFFPSFWDDPYHSNDIDGGLQWWDESHDLVHPTTNPTCLNNPTGISIPTTTTGPPNPANLNHPSPTDSSKKRKASPEQQHIDRKNHHGRPINPAVPGNQSGEEVVVVPVKKSNGNKKGTAKGTGNNCNNGNSKEGRWAEQLLNPCASAITGGNSTRVQHLLFVLHELASVTGDANHRLAAHGLHALNQHLSSSSSSSAPNGSASAAPVTFTSTEPRFFQKSLMKFYEVSPWFAFPNNIANSSILQLIAEEFDRTRTLHIVDVGVSHGMQWPTLLEALTHRPGGPPPLVKITVIAGAENNQNRGTPFAVGPPGENFSNRLLSFAKYMNINLQIKRLDDQPLKTLNAQLIDASNDETLIVCVQFRLHQLNHNAPDERTEFLKSLRSMEPKGVILSENNMECSCNNCGDFATGFSRQVEYLWRFLDSTSAAFKGRESEERRVMEGEAAKALTNRGEMNEGKEKWGERMRRVGFVGEVFGEDAIDGGRALLRKYDSNWEMKVDEKDGCVGLWWKGQPVSFCSLWKPHEREGNN

SEQ ID NO: 125 - protein, 492 aa, Lotus japonicus
MDMEIDIDDLLDFYGHSSTTPSSDDGGNWVPCSPLVDWDSFTAAADHDDFHHIIDSFMDYTLPAGDLTPEEESIGERSATTTEEEDDEATAADHSGKGLRLVHLLMAAAEALTGANKSHDLARAILIRLKELVSHTANTNMERLAAYFTDALQGLLDGAAGAHNLNKNSVVAGPHREDPQTDMLAAFQLLQDMSPYIKFAHFTANQAILEAVAHERRVHIIDFDVSEGAQWASLIQALSSRKDGPSGPHLRITALSRSCGRGGGRRSIATVQETGRRLTAFAASVGQPFSFHQCRLDPDETFRTSSLKLVRGEALVFNCVLHLPHLNYRAPDSIASFLSGARELSPKLVTLAEEEVGPVGDAGFVGLFMDSLHRYSAMCDSLEAGFPMQRWARGLVERVFLGPRITSSVARLYRTGEEDEEGSGSWGEWLVASGFRGVPISFTNHCQAKLLLGLFNDGYRVEELSNNKLVLSWKSRRLLSASVWTSSDDSNL

SEQ ID NO: 126 - protein, 680 aa, Cicer arietinum
MDTNKDLEVQNEEVGTSKTYEKEVKRGATIMQKVIKARSNGIKFEVGWNESGQPVDPNSSMFVSYIGAVVRQNVPITIDNWRDKALKDAKDIIWNDIQTTFVLDEERKSYVLRVAGKIHRGFRSHLSNFYLKDREGNTNAEPPKIYQHYISKDEWSAFVSKRSDPAFVNISKANRERASNPKHPYKKSRMGYARLEQQIRKDTQADQPLGRHILWKEARVNKEGVVDNENVKKVVELCETIEQSSETQEGNKDTCRDILGKVFNVPEYSGRVRGKGFGVTPKSFFPQEKRQKPSNEEVLEKLRILSEQVALLVNTNKDKQLPVQLQPEIQMESETGSCNVGLKSIPEGVTTCVLYLSSPTQRKVGKGILHNTSGEVLHNIPIPAGHVKVSPTVAFEPTAPLPIPDNDGDMKFLSDAIGSYVAWPTHLVALEKKIPKDKSVTSPEKVQINKPPLQPKKGSKPQKLEVNRAAKLQRLEGNKAAKLAATKNLDRGKSVAAAAAPNKSQPRLGKYGACLDIQIKRNMGSSNDSPIVQMNQDIFGDEYIEYLEKEQMYDLLEHKELSVTVISLYIRFLYEKVVCTRKLSNKYSFLSPHKMSMWKLDPENVKNYIVDMFLGNKESDKLFLAPYNSGAHWVLFAINAVSEVIYYLDPVHGDYTNHPGIKNMLDTTLPIPVHHILRKI

SEQ ID NO: 127 - protein, 508 aa, Medicago truncatula
MNMEIHDMDIDIDMIMDVVPDFLEFSNQSNTTTPPTSDDDTTWSPLLDLDFFTTNQDDFHNFIDSLTNDEITPVAPNLDNKVVEQDDEEEEEDGSMGDMSNSNSTTEEEEDDRKGLRLVHLLMAAAEALTGTNKSHHLAQVILIRLKDLVSSTHGTNMERLAAYFTDALQTLLNGTDCGGHHKLCLLTGPHQTDILSAFQLLQDMSPYVKFAHFTANQAILEAVTHERRVHIVDFDIMEGAQWASLIQSLSSRKEGLPGPHLRITALSRNKERGNGRSRSSFATVQETGRRLTTFAASVGQPFTFHQCRLESDERFRTSSLKLVRGEALVFNCVMHLPHLSYRASDSIASFLNGAKELGTKLVTLVEEEVGPITDAGFVGLFMDSLHRYSAMYDSFEAGFPMNKWARSLVEQVFLGPRIMGSVAQLYMTGEEEEQERGSWGEWLGVEGFRGVNISYGNHCQAKLLLGLFNDGYRVEELGNNKLVLGWKSRRLLSASVWTCMSEIEYDF

SEQ ID NO: 128 - protein, 507 aa, Trifolium subterraneum
MEIDIDMVMDVVPDILEFSNYSNTTTTPTSDEGITWSPLLDLDFFTTNQDHFHDFIDSLTNDEIITVDPNQGKTVSDQDEEEEGSMVDMSNSNSTTEEHNDGDDRKGLRLVHLLMAAAEALTGTNKSHHLAQVILIRLKDLVSSTHGTNIERLAAYFTDALQTLVNGADTAHGNTNNNHHNKLCLLTGPHQTDLLSAFQLLQDMSPYVKFAHFTANQAILEAVTHERRVHIVDYDITEGAQWASLIQSLSSRKEGLPGPHLRITALSRNKERGSGRRSTTATVQETGRRLTSFAASVGQPFTFHQCRLDSDEMFRASSLKLVRGEALVFNCVMHLPHLSYRASDSVASFFNGAKELGSKLVTLVEEEVGPTSEDGFVGLFMDSLHRYSAMYDSLEAGFPMNKWARSLVEQVFLGPRIMGSVAQLYMNGEEEGEVRASWGEWLGAEGFKGVTVSYGNHCQSKLLLGLFNDGYRVEEMGNNKLVLGWKSRRLLSASIWTCMSKSEFEFR

SEQ ID NO: 129 - protein, 430 aa, Cajanus cajan
MIDDPDFLDFSDHHSATTPSSPLIDWDSLAALVLSPDPPPAEDSDSTVATSEEEEEEGLRLVHLLLAAAEALSSGTESHSLARAILVRLNELASPSHGTNMERLGAHFSHALEHLLNGAGTAHSTPLPVTDTLLAFQLLQDMSPYVNFAHFTANQAILESLAHQKRLHVVDFDVSQGAQWASLIQALSSSPGPHLRITALSRGGERKSLATVQETGRRLTAFAASVKQPFSFHHCRLDPDETFRPSSLKLVRGEALVFNCILHLPHLAFRPSASVASFLEGAKELKASLVVVVEEEVGPIGDGGFLGLFMDSLHRYSAVFDSLEVGFPMQRWARGLVERVLLGPRIVGSVGRMFRGGETEEEEEGGSWVEWLGAGGFRGVPISFANHCQANLLVGLFNDGYRVEELGNNKLVLGWKSRRLLSASLWTSHS

SEQ ID NO: 130 - protein, 472 aa, Glycine max
MDMLIMDDPDFLDFSDHSITTTLSSHEDCNKNNNNLWSPLIDWESLNACENDFQTLIDSVMIDNNDDVLTPEESDQSAAEESESDSTGGDERGLRLLHLLMAAAEALSSGTESHDLARAILVRLNELVSPTQGTNIERLAAHFSHALHSLLNGTASAHTPPIDTLTAFQLLQDMSPYIKFAHFTANQAILEAVAHEKRVHIIDYDITEGAQWASLIQALSSAGPPGPHLRITALSRGGGGGGNSSSASGQRSTASVQETGRRLTAFAASVGQPFSFHHSRLDPDETFRPSNLKLVRGEALVFNCMLHLPHLNFRASGSVGSFLRGAKELNSRLVVLVEEEMGCVAADSGFVGFFMDSLHHYSAVFDSLEVGFPMQTWARALVEKVFLGPRITGSVARMYGSGTEEEKVSWGEWLGAAGFRGVPLSFANHCQANLLLGLFNDGYRVEELENNRLVLGWKSRRLLSASVWSSNS

SEQ ID NO: 131 - protein, 595 aa, Phaseolus vulgaris
PRVVVVVEEEVARGGDAGFVGLFMDSLQHYSAVFDSLEVGFPMQKWARALVERVFLGPRIANSIGLMYRSGGEDRGSWEEWLSAAGFRGVPVSFANHCQANLLLGLFNDGYRVEELENNKLVLGWKSRRLISASVWTSNSMDDPDFLDFSNRSITTSASSEEDWTNLWSPVVDWGSLAAGEDNFQTLFDSIVHKDDVVLTPDQTTAQDSDLSGHDEKGLRLVHLLMAAAEALTTGTESHHLARVILVRLNELVSPTHGTNIERLAAHFSSALQNLLDGAGSSHTITNNTPNPTDTLTAFHLLQDMSPYVKFAHFTANQAILEAVAHEKRVHIVDFDVTEGAQWASLMQSLSSRSTGPPGPHLRITALSRGSASGRRSIATVQETGRRLTAFAASVAQPFSFHQCRLDPGETFRPSLLKLIRGEALVFNCMLHLPHLSFRASGSVASFLKGAKELNPRVVLVVEEEVARGGDAGFVGLFMDSVQHYSAVFDSLEVGFPMQKWARALVERVFLGPRIANSVGLMYQSGEEERGSWEEWLGAAGFRGVPVSFANHCQANLLLGLFNDGYRVEELGNNKLVLGWKSRRLISASVWTSNS

SEQ ID NO: 132 - protein, 468 aa, Vigna unguiculata
MASLLSSSPIGAVMDDPDFLDFSNRSITTSSSSEEDWTNMWSPLVDWGSLAAGEDNFQTLIDSIVHEEDVVLTPDQTTPQDSDLSSHDEKGLRLVHLLMAAAEALTPGTESHYLARVILVRLNELVSPTHGTNIERLAAHFGSALQNLLDGTGSAHSITTDAPNPTDTLTAFHLLQDMSPYVKFAHFTANQAILEAVAHEKRVHIVDFDVTEGAQWASLMQSLSSRSTGPTAPHLRITALSRGSASGRRSIATVQETGRRLTAFAASVGQPFSFHQCRLDHGETFRPSSLKLIRGEALVFNCMLHLPHLSFRASGSVASFLKGAKELNPRVVVVVEEEVARGGDAGFVGLFMDSLQHYSAVFDSLEVGFPMQKWARALVERVFLGPRIANSIGLMYRSGGEDRGSWEEWLSAAGFRGVPVSFANHCQANLLLGLFNDGYRVEELENNKLVLGWKSRRLISASVWTSNS

SEQ ID NO: 133 - protein, 455 aa, Vigna angularis
MDDPDFLDLSKPSITTSSSSEEDWINLWSPLVDWGSLAAGEDNFQTLIDSIAHEDDVVSTPDQTIAQDSDLSSHDEKGLRLVHLLMAAAEALTPGTESHHLARVILVRLNELVSTTHGTNIERLAAHFSSALQNLLDGAGSAHSITTDTPNPTDTLTAFHLLQDMSPYVKFAHFTANQAILEAVAHEKRVHIVDFDVTEGAQWASLMQSLSSRSTGPPAPHLRITALSRGSAPGRRSIATIQETGRRLTAFAASVGQPFSFHQCRLDPGETFRPSSLKLIRGEALVFNCMLHLPHLSFRASGSVASFLKGAKELNPRVVMVVEEEVARGGDAGFVGLFMDSLQHYSAVFDSLEVGFPMQKWAQALVERVFLGPRIANSVSLMYRSGGEDRGSWEEWLGAAGFRGVPVSFANHCQANLLLGLFNDGYRVEEMGNNKLVLGWKSRRLISASVWTSNS

SEQ ID NO: 134 - skipped

SEQ ID NO: 135 - protein, 473 aa, Vigna radiata
MADRHTRDQSNTWMVERQVLENEKLVREFRSITTSSSSEEDWTNLWSPLIDWGSLAAGEDNFQILIDSIAHEHDVVLTPDQTTAQDPDLSSHDEKGLRLVHLLMAAAEALTPGTESHHLARVILVRLNELVSTTHGTNIERLAAHFSSALQNLLDGAGSAHSITTDTPNPTDTLTAFHLLQDMSPYVKFAHFTANQAILEAVAHEKRVHIVDFDVTEGAQWASLMQSLSSRSTGPPGPHLRITALSRGSTSGRRSIATIQETGRRLTAFAASVGQPFSFHQCRLDPEETFRPSSLKLIRGEALVFNCMLHLPHLSFRASGSVASFLKGAKELNPRVVMVVEEEVARGGDAGFVGLFMDSLQHYSAVFDSLEVGFPMQKWAQALVERVFLGPRIANSVSLMYRSGGEDRGSWEEWLGAAGFRGVPVSFANHCQANLLLGLFNDGYRVEEMGNNKLVLGWKSRRLISASVWTSNS

SEQ ID NO: 136 - protein, 151 aa, Lotus japonicus
MILLNSTTSGMEMDIDCIHHLDFSGHSTLTNTPSSDNDNYGCSWNHWSPVVNWDAFTGNQDDFHHLIDSMIDDNNTGPAFSDHTASTTSEEEEEEEATTTTMTTTTTTTTTTPEAADDDFKGLRLVHLLMAGAEALTGANKNRELARVILV

SEQ ID NO: 137 - skipped

SEQ ID NO: 138 - protein, 174 aa, Lotus japonicus
  VARIANT 173, 174: Xaa = Any Amino Acid
MEGVQWASLMQALASNPNGPHLRITALSRSGVGRRSMATVQETGRRLTAFATSLGQPFSFHHCRLESDETFRPAGLKLVRGEALVFNCMLNLPHLTYRSPNSVASILTAAKALRPRLVTVVEEEVGSALGGFVERFMDSLHHFSAVFDSLEAGFPMQGRARALVERVFLGPRXX

SEQ ID NO: 139 - protein, 509 aa, Lotus japonicus
MILLNSTTSGMEMDIDCIHHLDFSGHSTLTNTPSSDNDNYGCSWNHWSPVVNWDAFTGNQDDFHHLIDSMIDDNNTGPAFSDHTASTTSEEEEEEEATTTTMTTTTTTTTTTPEAADDDFKGLRLVHLLMAGAEALTGANKNRELARVILVRLKELVSHTDGTNMERLAAYFTEALQGLLEGAGGAYNSSSKHHVIGGPHHEPQNDALAAFQLLQDMSPYVKFGHFTANQAIVEAVAHERRVHIVDYDIMEGVQWASLMQALASNPNGPHLRITALSRSGVGRRSMATVQETGRRLTAFATSLGQPFSFHHCRLESDETFRPAGLKLVRGEALVFNCMLNLPHLTYRSPNSVASFLTAAKALRPRLVTVVEEEVGSALGGFVERFMDSLHHFSAVFDSLEAGFPMQGRARALVERVFLGPRIVGSLARIYRTGGGGEERGSWGEWLRAAGFSGVAVSSANHCQSNLLLGLFNDGYRVEELGSNKLVLHWKTRRLLSASLWTCSSESDCA

SEQ ID NO: 140 - protein, 59 aa, Cicer arietinum
MGMSNGGGGGGGGNWGATNPPKNADVEVATSSRGGGELNRASSVASHESEMALAKSMGS

SEQ ID NO: 141 - protein, 508 aa, Medicago truncatula
MDLMDMDAINDLHFSGHSSLTNTPTSDEDYGCTWNHWSPIVNWDTFTGAPDDFHHLMDTIIEDRTTVLEQLSPSITTTTTTTTTTDEEEEEMETTTTTTTTAIKTHEVGDDSKGLKLVHLLMAGAEALTGSTKNRDLARVILIRLKELVSQHANGSNMERLAAHFTEALHGLLEGAGGAHNNHHHHNNNKHYLTTNGPHDNQNDTLAAFQLLQDMSPYVKFGHFTANQAIIEAVAHERRVHVIDYDIMEGVQWASLIQSLASNNNGPHLRITALSRTGTGRRSIATVQETGRRLTSFAASLGQPFSFHHCRLDSDETFRPSALKLVRGEALVFNCMLNLPHLSYRAPESVASFLNGAKTLNPKLVTLVEEEVGSVIGGFVERFMDSLHHYSAVFDSLEAGFPMQNRARTLVERVFFGPRIAGSLGRIYRTGGEEERRSWGEWLGEVGFRGVPVSFANHCQAKLLLGLFNDGYRVEEVGVGSNKLVLDWKSRRLLSASLWTCSSSDSDL

SEQ ID NO: 142 - protein, 516 aa, Trifolium pratense
MYMEMDMDMDAIHDLDFSGHSSLTNTPSSDDDYGCNWNQWSPIVNWDTFAGAQDGFHHLMDTIIDDRTTLLDQLSPTTTTTTTTTEEEEEEEETETTTTTTTTTTTTTTTTEKAQAVGDDIKGLKLVHLLMAGAEALTGSTKNRDLAKVILVRLKELVSNHAHGSNMERLAAYFTEALHGLLEGAGGAHNNHHHHNNKHYLTTSGSHDNQNDTLTAFQLLQDMSPYVKFGHFTANQAIIEVVAHERRVHVIDYDIMEGVQWASLIQSLASNNNSPHLRITALSRTGAGRRSIATVQETGRRLTSFATSLGQPFSFHHCRLDSDETFRPSTLKLVRGEALVFNCMLNLPHLSYRSPDSVASFLNGAKALNPKLVTLVEEEVGSVVGGFVERFMDSLHHYSAVFDSLEAGFPMQNRARALVERVFFGPRIAGSLGRIYRTGGEEERKSWGGWLGAAGFRGVPVSFANHCQAKLLLGLFNDGYRVEEVGVGSNKLVLDWKSRRLLSASLWTCSSSDSDL

SEQ ID NO: 143 - protein, 521 aa, Trifolium subterraneum
MYMDMDMDMDAIHDLDFSGHSTLTNTPSSDDDYGCNWNQWSPIVNWDTFTGTQDGFHHLMDTIIDDRTTLLHQLSPTTTTTTTTTTDEEEEEETETTTTTTTTTTTATTEKAQAVEDDIKGLKLVHLLMAGAEALTGSTKNRDLAKVILVRLKELVSNHAHGSNMERLAAYFTEALHGLLEGAGGAHNNHHHHHHNNNNNKHYLTTGGPHDNQNDTLTAFQLLQDMSPYVKFGHFTANQAIIEAVAHERRVHIIDYDIMEGVQWASLIQSLASNNNSPHLRITALSRTGAGRRSIATVQETGRRLTSFAASLSQPFSFHHCRLDSDETFRPSTLKLVRGEALVFNCMLNLPHLSYRAPDSVASFLNGAKALNPKLVTLVEEEVGSVVGGFVERFMDSLHHYSAVFDSLEAGFPMQNRARALVERVFFGPRIAGSLGRIYRTGGEEERKSWGEWLSAAGFRGVPVSFANHCQAKLLLGLFNDGYRVEEVGVGSNKLVLDWKLRRLLSASLWTCCSSSSDSDL

SEQ ID NO: 144 - protein, 502 aa, Glycine max
MEIDMDMDFSGYSTITNTIPSSDDDYGCNWNHWSPVVNWDAFTGAHDDFHHLIDSIMCDSAAAEEDNLSPDDHAASNSPSASVTEEEDDDADEETGPVDDSKGLRVVHLLMAAAEALTGAPKSRDLARVILVRLKELVSHAAPPHGSNMERLAAYFTDALQGLLEGASGGAHNNKRHHHYNIITSSCGPHHRDDHHNHQSNTLAAFQLLQDMSPYVKFGHFTANQAILESVAHERRVHIVDYDIMEGVQWASLMQALASNKTGPPGPHLRITALSRTGSGRRSIATVQETGRRLTAFAASLGQPFSFHHCRLDPDETFKPSSLKLVRGEALVFNCMLNLPHLSYRAPDSVASFLSGAKALKPRLVTLVEEEVGSSAGGFVGRFMESLHHYSAVFDSLEAGFPMQGRARALVERVFFGPRIVGSLGRLYRTGEEERGSWGEWLGAAGFRGVPMSFANHCQAKLLIGLFNDGYRVEELGTNKLVLDWKSRRLLSASLWTQINSF

SEQ ID NO: 145 - protein, 495 aa, Glycine max
MDIDAIHNLDFSGYSTITNTTPSSDDDYGCNWNHWSPVVNWDAFTGAHDDFHQIIDSIMCDGAAPEEDNLSPDDHVASNSPSVSITEEDDDAGDDSKGLRLVHLLMAAAEALSGAPKSRDLARVILVRLKELVSSHAAPHGSTMERLAAYFTDALQGLLEGAGGAHNNNNKHHHHYITSCGPHHHHRDDHHHQNDTLAAFQLLQDMSPYVKFGHFTANQAILEAVAHDRRVHIVDYDIMEGVQWASLIQALASNKTGPPGPHLRITALSRTGSGRRSIATVQETGRRLAAFAASLGQPFSFHHCRLEPDETFKPSSLKLVRGEALVFNCMLNLPHLSYRAPESVASFLSGAKALKPRLVTLVEEEVASIVGGFVARFMDSLHHYSAVFDSLEAGFPMQGRARALVERVFLGPRIVGSLARMGEEEERGSWGEWLGAAGFRGVPMSFANHCQAKLLIGLFNDGYRVEELGSNKLVLDWKSRRLLSASLWTSSSHSD

SEQ ID NO: 146 - protein, 479 aa, Cajanus cajan
MDMDTIHNLDFSGYSTITNTTPSSEDDYAYCTWNHWSPLVNWDALTATPDDFHHLLDSIVSDGAVEDNLSPDNVGSNSVTEEEDLKGLRLVHLLMAAAEALTGATKSRELARVILVRLKELVSHSAHASNMERLAAYFTDALQGLLEGAGGAHNNNTRHHPNHYHQNDTLAAFQLLQDMSPYVKFGHFTANQAILEAVAHERRVHIVDYDIMEGVQWASLMQALASNKTGPPAPHLRITALSRTGTGTARRSIASVQETGRRLTAFAASLGQPFSFHQCRLDSDETFRTSSLKVVHGGGAGEALVFNCMLNLPHLSYRAPDSVASFLSGAKALKARLVTVVEEEEEAGSNVGGFVGRFMDSLHHYSAVFDSLEAGFPMQSRARALVERVFLGPRIAGSLGRIYRTGEEEERGSWGEWLGAAGFRGVPLSFANHCQAKLLLGLFNDGYRVEELGSNKLVLDWKSRRMLSASLWTSSPDSH

SEQ ID NO: 147 - protein, 502 aa, Vigna unguiculata
MEIDMDPDMDVIHNLHFSRHTTPSSDDDYGCNWNHWSPLVNWDAFTGSHDDFHNLIDSIVSDGPAEYPSPDDHAASNSPSASITEQDDEDEETAAADDSKGLRLVHLLMAAAEALTGTTKSRELARVILVRLKDLVSHASHGSNMERLAAYFTDALRGLLEGAGGAHNHSKHHYNITYGSHHPRDDHHHHHHQNDTLAAFQLLQDMSPYVKFGHFTANQAILETVAHERRVHIVDYDIMEGVQWASLMQALASDKTGPPGPHLRITALSRTGTGRRSITTVQETGRRLTAFAASLGQPFTFHQCRLDPDETFKPSSLKLVRGEALVLNCMLNLPHLSYRTPDSIASFLSGAKELKPRLVTLVEEEVGSSVGGFVGRFMDSLHHYSAVFDSLEAGFPMQGRARALVERVFLGPRIVGSLARVYRTGEEVEERGSWGEWLGAAGLRGVPMSFANHCQAKLLLGLFNDGYRVEELGANKLVLDWKSRRLLSASLWTSSSSSSDSH

SEQ ID NO: 148 - protein, 505 aa, Vigna unguiculata
MEIDMDTDMDAIHNLHFSRYTTITDTAPSSDDDYGCNWNHWSPLVNWDAFTGSHDDFHHLIDSIVSEGPAEYPSPQDHAASNSPSASITEEDDAEEETASADDSKGLRLVHLLMAAAEALTGAAKSRELARVILVRLKDLVSHASHGSNMERLAAYFTDALRGLLEGAGGAHNHSKHHYNITYGSHHPRDDHHHHHQNDTLAAFQLLQDMSPYIKFGHFTANQAILEAVVHERRVHIVDYDIMEGVQWASLMQALASDKTGPPGPHLRITALSRTGTGRRSIATVQETGRRLTAFAASLGQPFTFHQCRLDPDETFKPSSLKLVRGEALVLNCMLNLPHLSYRAPDSIASFLSGAKELKPRLVTLVEEEVGSSVGGFVGRFMDSLHHYSAVFDSLEAGFPMQGRARALVERVFLGPRIVGSLARVYRTGEEVEERGSWGEWLGAAGLRGVPMSFANHCQAKLLLGLFNDGYRVEELGPNKLVLDWKSRRLLSASLWTSSSSSDSH

SEQ ID NO: 149 - protein, 501 aa, Phaseolus vulgaris
MEIDMDYHTDAIHSLHFSGYATITDTTPSSDDDYDCNWNHWSPLVNWDAFTGPHDDFHHLIDSIVSDGATAEYLSPDDHAASNSPSPSITEEDDAEEETAAADDSKGLRLVHLLMAAAEALTGATKSRDLARVILVRLKDLVSHAAHGSNMERLAAYFTDALQGLLEGAGGAHNNSKHHHYITCGSHHPRDDHHQNDTLAAFQMLQDMSPYVKFGHFTANQAILEAVAHERRVHIVDYDIMEGVQWASLMQALASNKAGPPGPHLRITALSRTGTGRRSVATVQETGRRLTAFAASLGQPFTFHQCRLDPDETFKPSSLKLVRGEALVFNCMLNLPHLSYRAPDSIASFLSGARELKPRLVTLVEEEVGSSVGGFVGRFMELLHHYSAVFDSLEAGFPMQGRARALVERVFLGPRIVGSLARIYRTGEELQERSWGEWLGASGFRGVPMSFANHCQAKLLLGLFNDGYRVEELGANRLVLDWKSRRLLSASLWTSSSSDSH

SEQ ID NO: 150 - skipped

SEQ ID NO: 151 - protein, 502 aa, Vigna angularis
MEIDMNTDIDAIHNLHFSGYTTITDTTPSSDDDYGCNWNHWSPLVNWDAFTGSHDDFHHLIDSIVSDGPAEYPSPEDHAASNSPSASITEEDDAEEETAAADDSKGLRLVHLLMAAAEALTGATKSRDLARVILVRLRDLVSHASHGSNMERLAAYFTDALQGLLEGAGGAHNNSKHHYYITCGSHHPRDDHHHQNDTLAAFQLLQDISPYVKFGHFTANQAILEAVAHERRVHIVDYDIMEGVQWASLMQALASDKTGPPGPHLRITALSRTGTGRRSIASVQETGRRLTAFAASLGQPFTFHQCRLDPDETFKPSSLKLVRGEALVFNCMLNLPHLSYRAPDSIASFLSGAKELKPRLVTLVEEEVGSSVGGFVGRFMDSLHHYSAVFDSLEAGFPMQGRARALVERIFLGPRIVGSLARIYRTGEELEERRSWGEWLGAAGFRGVPMSFANHCQAKLLLGLFNDGYRVEELGTNKLVLDWKSRRLLSASLWTSSSSDSH

SEQ ID NO: 152 - protein, 503 aa, Vigna radiata
MEIDTNTDIDAIHNLHFSGYTTITDTNPSSDDDYGCNWNHWSPLVNWDAFTGSHDDFHHLIDSIVSDPPTEYPSPEDHAASNSPSASITEEDDAEEETAAADDSKGLRLVHLLMAAAEALTGATKSRDLARVILVRLKDLVSHSSHGSNMERLAAYFTDALQGLLEGAGGAHNNSKHHYYITCGSHHPRDDHHHQNDTLAAFQLLQDMSPYVKFGHFTANQAILEAVAHERRVHIVDYDIMEGVQWASLMQALASDKTGPPGPHLRITALSRTGTGRRSIASVQETGRRLTAFAASLGQPFTFHQCRLDPDETFKPSSLKLVRGEALVFNCMLNLPHLSYRAPDSIASFLSGAKELKPRLVTLVEEEVGSSVGGFVGRFMDSLHHYSAVFDSLEAGFPMQGRARALVERIFLGPRIVGSLARIYRTGEELEERRSWGEWLGAAGFRGVPMSFANHCQAKLLLGLFNDGYRVEELGTNKLVLDWKSRRLLSASLWTSSSSSDSH

SEQ ID NO: 153 - protein, 575 aa, Oryza sativa
MEVTMEDVAGDFEFSGCGSTTTTSSASSLDDGTGMCYAWGELSPVADWANFCCSDDDGGHDLHGLIESMLCDDTLVGVDDDGQAGLHHADMFRDDLYCYGNGSNPSSTTTTNPGSPVFDDPTQGCPEKGLRLLHLLMAAAEALSGPHKSRELARVILVRLKEMVSHTASANAAASNMERLAAHFTDALQGLLDGSHPVGGSGRQAAAAASHHHAGDVLTAFQMLQDMSPYMKFGHFTANQAILEAVSGDRRVHIVDYDIAEGIQWASLMQAMTSRADGVPAPHLRITAVSRSGGGGARAVQEAGRRLSAFAASIGQPFSFGQCRLDSDERFRPATVRMVKGEALVANCVLHQAAATTTIRRPTGSVASFLSGMAALGAKLVTVVEEEGEAEKDDDGDSAGDAAAGGFVRQFMEELHRYSAVWDSLEAGFPTQSRVRGLVERVILAPNIAGAVSRAYRGVDGEGRCGWGQWMRGSGFTAVPLSCFNHSQARLLLGLFNDGYTVEETGPNKIVLGWKARRLMSASVWAPPPLPVPSSPPEGVCQPVVGMAPVATGGFARTEFDYIDSFLVEPAYALV

SEQ ID NO: 154 - skipped

SEQ ID NO: 155 - protein, 580 aa, Brachypodium distachyon
MDVTMEDVVGDLEISGCSSSTATSSPSSSSLVDDDMGLYAWNALSPVADWGPFCSDDGGQDLHGLIESMLSDDALVGADPASSLFHQAGPCYSNGSDPSSTTTTNPGTPVYDDPAQAQAECSPEKGLRLLHLLMAAAEALSGPHKSRELARVILVRLKDMVSSTSDAAASNMERLAAHFTDALQGLLDGSHPLSGAGKQAAAMAAAASSSSLHHHHYNASDVLTAFQMLQDMSPYMKFGHFTANQAILEAVAGDRRVHVVDYDLAEGIQWASLMQAMTSRPDGVSPPHLRITAVTRGGGGGARAVQEAGRRLAAFAGSIGQPFSFGHCRLDSDERFRPATVRMVKGETLVANCILHQAAATTTVRRPTGSVASFLTGMAALGAKVVTVVEEEGEASSEKESDEKEEGAAGGFVARFMEELHRYSAVWDSLEAGFPTQSRVRGLVERVILGPNIAGAVSRAYRGGMDGGRGGWGEWMRGSGFKAVPLSCFNHSQARLLLGLFNDGYTVEETRPNKIVLGWKARRLLSASVWAPPPLSVPSSPAEAVFQPIGMAMAPAASGFGRMEFDFIDSFLVEPAYALV

SEQ ID NO: 156 - protein, 606 aa, Hordeum vulgare
SLCTCKICAPCPPLSPRFPRAKTFQRGDKKQHSVTTREGAMDVTMEDVVGDLEISGYSSTSISASPSSSLDDGMGLYGWNALSPVADWGMFCSDDGGHDLHGLIESMLCDDTLIGTPEPDEHPDPAMFTDGPCYSNGSDPSSTTTTNPGTPVQHDDDLPQDCNPEKGLRLLHLLMAAAEALSGPHKSRELARVILVRLKEMVSSTSGNAAASNMERLAAHFTDALQGLLDGSHSVAGTSRQAASHHHSTGDVLTAFQMLQDMSPYMKFGHFTANQAILEAVAGDRRVHIVDYDLAEGIQWASLMQAMTSRPDGVSPPHLRITAITRSGGGGARAVQEAGRRLAAFAGSIGQPFSFGHCRLDSDERFRPATVRMVKGETLVANCILHQAAATTTVRRPTGSVASFLTGMASLGAKVVTVVEEEGEAEKNEEEASDAAAGGFVGRFMEELHRYSAVWDSLEAGFPTQSRVRGLVERVILAPNIAGAVSRAYRGADGEGRRGWGEWMRGSGFEMVPLSCFNHSQARLLLGLFNDGYTVEETRPNKIVLGWKARRLLSASVWAPPPLSVPSSPAEGVCQPMGMAPASGGFGRTEYDYVDSFLVEPAYALV

SEQ ID NO: 157 - protein, 566 aa, Setaria italica
MDVTMDDVAGDLEFSGCSSTTTSSSSPSLDDGMGMYAWNGLSPVADWGSFYPDDGGQDLHGLIESMLCDDTLVGAADLHPAMFPDEVYCCSNGSAPSSTTTTNPGTPVNDGDAAQGDCPEKGLRLLHLLMAAAEALSGPHKSRELARVILVRLKQMVSHTGDSAAVSNMERLAAHFTDALQGLLDGSHPAGGAGRQAAAASHGHHHQHAGDVLTAFQMLQDMSPYMKFGHFTANQAILEAVAGDRRVHVVDYDIAEGVQWASLMQAMISRPDGVPPPHLRITAVSRGGGGGARAVQEAGRRLAAFAASIGQPFSFGQCRLDSDERFRPATVRMVKGETLVANCVLNQAAATTTIRRPTGSVASFLAGMATLGAKVVTVVEEDQGEPEKDDEEAGGGFVARFMEELHRYSAVWDSLEAGFPTQSRVRGLVERAILAPNIAGAVSRAYRAVDGDGEAARAGWGEWMRGNGFRAVPLSCFNHSQARLLLGLFNDGYTMEETSPNRIVLGWKARRLLSASVWAPPPMSVPSSPAEGAFQPVGIAPASGGVDRMEFDYIDSFLVEPAYALV

SEQ ID NO: 158 - protein, 556 aa, Sorghum bicolor
MEVTMDDVAGDVEFSGCSSTTTSSSSPSLDDGMGMYAWNALSPVADWGSLCPDDGAQDLHGLIESMLCDDTLLGSADLNPAMFPDDVYYCSNGSAPSSTTTTNPGTPVNGGDAQKGDCHEKGLRLLHLLMAAAEALSGQQKSRELARMVSHIGDNAAVSNMERLATHFTDALQGLLDGSHPIGGVGRQAAAAASHGHLPHTGDVLTAFQMLQDMSPYMKFGHFTANQAILEAVAGDRRVHVVDYDIAEGVQWASLMQAMTSRPDGVPPPHLRITAVSRGGGGGARAVQEAGRRLAAFAASIGQPFSFGQCRLDSDERFRPATVRMVKGETLVANCVLNQAAATTTVRRPTGSVASFLAGMATLGAKVVTVVEEDQGDAEKDDEEVGGFVARFMEELHRYSAVWDSLEAGFPTQSRVRGLVERAILAPNIAGAVSRAYRASDGDGEARAGWGEWMRGNGFRAVPLSCFNHSQARLLLGLFNDGYTMEETSPNKIVLGWKARRLLSASVWAPPPVSVPSSPTEGAFQPVGMSPTSGGVGRMDFDYIDSFLVEPAYALV

SEQ ID NO: 159 - protein, 564 aa, Zea mays
MEVTMDDVAGDLEFSGCSSTTTSPSSPSLDDGMGMYAWNALSPVTDWGSLCPDDGAQDLHGLIESMLYDDTLLGSADLNPAMFPDDVYCCSNGSAPSSTTTTNPGTPVNDGDAQKGDCHEKGLRLLHLLMAAAEALSGPQKSRELARVILVRLKQMVSHIGDNAAVSNMERLATHFTDALQGLLDGSHPVGGAGKQAAAAASHGHQQHTGDVLTAFQMLQDMSPYMKFGHFTANQAILEAVAGERRVHVVDYDIAEGVQWASLMQAMTSRPDGVPPPHLRITAVSRGGGGSARAVQEAGRRLAAFAASVGQPFSFGQCRLDSDERFRPATVRMVKGETLVANCVLNQAAATTTVRRPTGSVASFLAGMATLGAKVVTVVEEDQGHAEKDDEGAGGFVARFMEELHRYSAVWDSLEAGFPTQSRVRGLVERAILAPNIAGAVSRAYRAVDGDGEARAGWGEWMRGNGFRAVPLSCFNHSQARLLLGLFNDGYTMEETSPNKIVLGWKARRLLSASVWAPPPVSVPSSPTEGAFQPVGMSPDSGGVGRVDFDYIDSFFVEPAYALV

SEQ ID NO: 160 - protein, 409 aa, Selaginella moellendorffii
MNFDDFQLPGDPELDLQHQEFFGCRLFHLLLAGAEAMFSQALDLAKVILFRLRELTSSCSSSGPVFQRLALYFTEALQSLLDGARITKVASSCSMSYLDSITAFQALHEASPYIKFGHYVANQAILEAIGDDKRVHILDYDVTLGIQWPSLMQALALREGGTPHLRITAVYRPHSRHQLANFQETKERLMECAAAFKIPFSFHQAKVEDDEDSKLVGLKLIKGETLIVNCMLHLLHVPHKSPSSVLSFLKSVQKFSPRLVTFVEEEVVSCLSAPNTVDKFFQALHHYSAMLDSLEASLCETTAHILVERAFLATRIKTALIAHHHAHSKVEWSSLLHSAGFHRVSLSRRNICQARLLLGLFKDGYQLKEHHSDEEIEKLLLSWKSRPLIAASAWTCKNKSSDGSENEQQ

SEQ ID NO: 161 - protein, 438 aa, Selaginella moellendorffii
MLDDHERSFPDPQQVAVNPVSPPQYQQQQEIERSLVDFRHHSHDERVDFVYPELGVQVHPWDEDMDSIRLVHLLLGAAEATVCGETDLAIAIIDRLKSCCSTQSGTTMQRIAAYFRDALNCRLHGLKFFSRTESQFDTVGAFHVLHEICPYIKFGHFSANQAILESVAGEQRVHIFDFDITDGVQWPSLMQSLALRAGGPPQLKITALYRPNSKGALSTTQETGKRLAACARQFNVPFVFNQVRVDGESEEFLSSSLKLIQGEALVVNCMLHLPHMSCHSRDAVRFFLGKMAALRPRVLAIVEEDLSCTSTTFTGRFHEALYHYSTLFDSLEATLASEDEMRSLVERVFLGPRIKNTVTSAVSRSPLEKEANRWSGLAEAVGFQQRSFSSYNRCQARLLVGLFQDGHQIQEDEDTMLLCWKSRPLIAASVWSSSSDPA

SEQ ID NO: 162 - protein, 483 aa, Arabidopsis thaliana
MNYPYEDFLDLFFSTHTDPLATAASTSSNGYSLNDLDIDWDCDFRDVIESIMGDEGAMMEPESEAVPMLHDQEGLCNSASTGLSVADGVSFGEPKTDESKGLRLVHLLVAAADASTGANKSRELTRVILARLKDLVSPGDRTNMERLAAHFTNGLSKLLERDSVLCPQQHRDDVYDQADVISAFELLQNMSPYVNFGYLTATQAILEAVKYERRIHIVDYDINEGVQWASLMQALVSRNTGPSAQHLRITALSRATNGKKSVAAVQETGRRLTAFADSIGQPFSYQHCKLDTNAFSTSSLKLVRGEAVVINCMLHLPRFSHQTPSSVISFLSEAKTLNPKLVTLVHEEVGLMGNQGFLYRFMDLLHQFSAIFDSLEAGLSIANPARGFVERVFIGPWVANWLTRITANDAEVESFASWPQWLETNGFKPLEVSFTNRCQAKLLLSLFNDGFRVEELGQNGLVLGWKSRRLVSASFWASCQTNQ

SEQ ID NO: 163 - protein, 487 aa, Solanum lycopersicum
MAMMVDETITDFDCYGSLSIATTTITTTTATTSSSSWNDWSPVFDWDVFSGGDNFQDLIESMVQGSGNCFYKSEHQDCAEFMEEEEESGDSNNNQSEDINGLKLVHLLMAAAEALTGVNKSRELARVILVRLKELASPNGATNMERLAAYFTDALQALMASGTLHTKHMFSPNYKDEHRQGDVLAAFQLLQDMSPFVKFGHFTANQAIFESVTHDRRVHIIDYDIMEGIQWASLMQALVSRKDGPPTPHLRITALSRSGSGRRSFGTVQETGRRLTAFAASIGQPFSFHHCRLDSDEIFKPTNVKLVRGEALIINCMLHLPHFSYRASDSVASFLSGSKTLNPRLVTLVEEELRPIGDEEGFVGRFMDTLHHYSALYDSLEAGFPLQSRARALVERVFLGPRITGSLARIYRARGEGERCSWGEWLSGVGFCESNISFANHCQAKLLLGLFNDGYRMEEIGTNKLVLGWKSRRLLSASIWTTMDIDL

SEQ ID NO: 164 - protein, 487 aa, Theobroma cacao
MAMAIDNAFEVDFSSYSTTTTTTTTDDDLACTWNDWGSPVVDWDSLSSERDEFQDLIESMMDDGTGIELARVDHETSNSVSIDTMVADEESNREDFKGLRLVHLLIAAAEALTGANKSRELARVILVRLKELVSPNDGTNMERLAAYFTEALQGLLEGSGGGHGKHFITNGPHYHRDEHHQTDVLAAFQLLQDMSPYVKFGHFTANQAILEAVAHDRRIHIVDYDIMEGIQWASLMQALVSRKDGPPAPHLRITALSRSGSGRRSIGTIQETGRRLVAFAASIGQPFSFHQYRLDSDETFRPSAVKLVRGEALVINCMLHLPHFSYRAPDSVASFLTGAKTLDPRLVTLVEEEVGPIGDGGFVGRFMDSLHHYSAVYDSLEAGFPMQGRARALVERVFLGPRIAGSLTRIYRTRGEEESCPWSEWLAAVGFKPVNISFANHCQAKLLLGLFNDGYSVEELANNRLVLGWKSRRLLSASIWTSPDSDF

SEQ ID NO: 165 - protein, 498 aa, Manihot esculenta
MAIAIDGAFDELDFSGYGSISTTTTPTTSAENDHHACNWNDFSPVVDWEALSCHHDDFHDLIESMMEDGGFSQPICNSNSNSFSSDTMLVDEETNGEDFKGLRLVHLLMAAAEALTGVNKSRDLARVILIRLKELVSHNDGTNMERLAAYFTDALQGLLEGAGGGSHGKHLINNGPYHHHHRDDHHHQADVLAAFQLLQDMSPYVKFGHFTANQAILEAVAQDKRIHIVDYDIMEGIQWASLMQSLASRKDGPPTPHLRITALSRSGSGRRSIGTVQETGRRLVAFAASIGQPFSFHQCRLDSDETFRPSALKLVRGEALVINCMLHLPHFSYRAPDSVASFLSGSKTLNPRLLTLVEEEVGPIGDGGFVGRFMDSLHHYSAVYDSLEAGFPMQGRARALVERVFLGPRIAGSLARIYRARGDKEGCCWVEWLGATGFKEVNISFANHCQAKLLLGLFNDGYRVEEMGCNRLVLGWKSRRLLSASIWTSPSDSDLQII

SEQ ID NO: 166 - protein, 581 aa, Manihot esculenta
AGSLARIYRARGDKEGCCWVEWLGATGFKEVNISFANHCQAKLLLGLFNDGYRVEEMGCNRLVLGWKSRRLLSASIWTSPSDSDLQIIMAMAIDGALELDFSGYSSTATNTTTTTTTSTENDQHDGNWNGWSPVVDWEALSAHHDDFQDLIESMMDDGGLNQTTCNSNSLSTDTMMVDDETSSEDFKGLRLVHLLMAAAEALTGVNKSRDLARVILVRLKELVSPNDGTNMERLAAYFTDALQGLLEGAGGGHGKNSINNGPYHHHHRDDHHHQEDILAAFQLLQDMSPYLKFGHFTANQAILEAVAQDRRIHIVDYDIMEGIQWASLMQSLVSRTDGPPTPHLRITALSRSGSGKKSIGTVQETGRRLVAFAASIGLPFSFHQCRLDSDENFRPNALKLVRGEALVINCMLQLPHFSYRAPDSITSFLSGAKTLNPRLVTLVEEEVGSIGDGGFVSRFINSLHHYSAVYDSLEASFPMQSRARALVERVFLGPQIAGTLARIYRARANEEGSSWGERLGAVGFRAANISFANHCQAKLLIGLFNDGYRVEKLDGNRLVLGWKSRRLLSASIWTSPFDSDL

SEQ ID NO: 167 - protein, 491 aa, Ricinus communis
MAMAIDGSFELDFSGCSTTTTSSTENDHDRACNWNDWSPLVDWEALSAHHDDFQDLIESMMEDGGLHQNHETCNSNPNSPSSTDTMAIDEETSGEDFKGLRLIHLLMAAAEALTGVNKSRELARVILVRLKELVSPNDGTNMERLAAYFTDALQGLLEGHGTSTKHLIHNSGPYQHHHHHHQADTLAAFQLLQDMSPYVKFGHFTANQAILEAVSQDKRIHIVDYDIMEGIQWASLMQSLVSRKDGPPTPHLRITALSRGGNSGKRSIGTVQETGRRLVAFAASIGQPFSFHHCRLDSDESFRPSALKLVRGEALIMNCMLHLPHFSYRAPDSVASFLSGSKTLSPRLVTLVEEEVGPVGDGGFVGRFMDSLYHYSALYDSLEAGFPMQSRARALVERVFLGPRIAGSLDRIYRGYGDEEGSSWGEWSSGAGFRPVNISFANHCQAKLLLGLFNDGYRVEELGCNRLVLSWKSRRLLSASIWTSPSSDCDL

SEQ ID NO: 168 - protein, 495 aa, Citrus sinensis
MAMDFDDFLHLDFSGYSSTTTTTTTGDDYACNWNDWSPVVDWEALSGGQDDFHDLIESMMDDSGLNPNARVANIAHEPCNSVSTETSSSSMAVDEETNGEDFKGLRLVHLLMAAAEALTGVNKSRELAQVILIRLKELVSPNDGSNMERLAAYFTDALQGLLEGAGGVHGNNKHYTSNGPHHRDDHHHTDVLAAFQLLQDMSPYVKFGHFTANQAILEAVANDRRVHIVDYDIMEGIQWASLMQALVSRKDGPPAPHLRITALSRGGSGRRSISTVQETGRRLVAFAASIGQPFSFHQCRLDSDETFKASALKLVRGEALIINCMLHLPHFSYRAPDSIASFLSGAKTLNPRLVTLVEEETGPIGDGGFVSRFMDSLHHYSAVYDSLEAGFPMQSRARALVERVFLGPRISGSLARIYRTCGEEEVYSWGDWLGVVGFKPVNISFANHCQAKLLLGLFNDGYRVEELANNRLVLGWKSRRLLSASVWTSSFDSNL

SEQ ID NO: 169 - protein, 495 aa, Citrus clementina
MAMDFDDILHLDFSGYSSTTTTTTTGDDYACDWNDWSPVVDWEALSGGQDDFHDLIESMMDDSGLNPNARVANIAHEPCNSVSTETSSSSMAVDEETNGEDFKGLRLVHLLMAAAEALTGVNKSRELAQVILVRLKELVSPNDGSNMERLAAYFTDALQGLLEGAGGVHGNNKHNTSNGPHHRDDHHHTDVLAAFQLLQDMSPYVKFGHFTANQAILEAVANDRRVHIVDYDIMEGIQWASLMQALVSRKDGPPAPHLRITALSRGGSGRRSISTVQETGRRLVAFAASIGQPFSFHQCRLDSDETFKASALKLVRGEALIINCMLHLPHFSYRAPDSIASFLSGAKTLNPKLVTLVEEETGPIGDGGFVSRFMDSLHHYSAVYDSLEAGFPMQSRARALVERVFLGPRISGSLARIYRTCGEEEVYSWGDWLGAVGFKPVNISFANHCQAKLLLGLFNDGYRVEELANNRLVLGWKSRRLLSASVWTSSLDSNL

SEQ ID NO: 170 - protein, 503 aa, Populus trichocarpa
MAMAIDGAKFELDFSSYSSTTTTTTPTTSTENDHGCNWNDWSPMVDWEALSGAQDDFQDLIDSMMDDGALMNQSIRLTPDTSNSMSTSDTMLVDEETSCSDDLKGLRLVHLLMAAAEALTGLNKNRDLARVILVRLKELVSPNDGTNMERLAAYFTDALQGLLEGSGSIHSNKHLSGTNNGPYHHHHRDDPQHHHHQSDVLAAFQLLQDMSPYVKFGHFTANQAILEAVADDRRIHIVDYDIMEGIQWASLMQALVSRKDGPPTPHLRITALSRGGSGRRSIGTVQETGRRLVAFAASIGQPFSFHQCRLDSDETFRPSALKLVRGEALVMNCMLQLPHFSYRAPDSVASFLSGAKTLNPRLIAMVEEEVGPIGDGGFVSRFMDSLHHYSALYDSLEAGFPMQGRARALVERVFLGPRIAGSLARIYSARGEDGCSWGERLAAVGFQPIKISFANHCQAKLLLGLFNDGYRVEELASNRLVLGWKSRRLLSASIWTSPSDPDL

SEQ ID NO: 171 - protein, 507 aa, Populus trichocarpa
MAMAIDGTKFELDFSGYSSTTTTATTTPTISTENDHDHACNWNDWSPMVDWEALSGPHDDFQDLIDSMMDDGALMNQSSRLTPDTSNSMSTSDTVFVDEETSCSNDFKGLRLVHLLIAAAEALTGLNKNSDLARVILVRLKELVSPNDGTNMERLAAYFTDALQGLLEGTGGIHSNKHHSVTNNGPYHHHHRDDPQQHRHQNDALAAFQLLQDMSPYVKFGHFTANQAILEAVAEDRRIHIVDYDIMEGIQWASLMQALVSRKDGPPTPHLKITAMSRGGSSRRSIGTVQETGRRLVAFAASIGQPFSFHQCRLDSDETFRPSALKLVKGEALVMNCMLHLPHFSYRAPDSVASFLSGAKTLNPRLITMVEEEVGPIGDGGFVGRFMDSLHHYSAFYDSMEAGFPMQGRARALVERVILGPRISGSLARIYRARGEEVCPWWEWLAARGFQPVKVSFANNCQAKLLLGVFNDGYRVEELASNRLVLGWKSRRLLSASIWTSPSDPDL

SEQ ID NO: 172 - protein, 513 aa, Malus x domestica
MTQLLLNSVMAMAIDGHDDPDLDLSGCSPTTTSTNTVSTDHWYAWSPLVDWEALAPIDQLAGDDFHGLIESMVEDQDGSTELNSSSAQDEPLELEASNDTTTLGEMMTLTDEDGCANGEDLKGLRLVHLLIAAAEALTGAYKSRDLARVILVRLKELVSPTDGSNMERLAAYYTEALQGLLEGTGGLLGKHLIGSGAHRNHGHHPMDVTVAFQLLQDMSPYVKFGHFTANQAILEAVVHERRIHVVDYDIMEGIQWASLMQALVSRKEGPPTPLLRITALSRGGSRRQSIGTVQETGRRLTEFAASIGQPFSFHQCRLGSDETFQPSALKLIKGETLVINCMLNLPHFSYRSPDSIASFLSGAKTLSPRLVTLVEEDVRSTWDGGFVARFMDSLYHYSAVYDSLEAGFPMQSRARALVERVFLGPRIVGSLAHIYRAHGEVGHSWRERLGAVGFKPIPISFANHCQAKLLLGLFNDGYRVEEVTNHRLVLGWKSRCLLSASIWTSPLESDVVN

SEQ ID NO: 173 - protein, 506 aa, Prunus persica
MAMAIDQTLGGHAFDLDLSGCSTTTNNTMSSDHWYDWSPVVDWDALPPTDQLAGDDFHELIESMMEDQEGTELNSSSAQDEVHELEASNDTTSSGEIMMLTEEDGGANGEDSKGLRLVHLLMAVAEALTGANKSRDLARVILVRLKELVSPTDGTNMERLAAYFTEALQGLLEGAGGVQGKHLIGNGTHRDHGHHPTDVIAAFQLLQDMSPYVKFGHFTANQAILEAVVHDRRVHVLDYDIMEGIQWASLMQALVSRKDGPPTPHLRITALSRGGSGSGRRSIGTIQETGRRLTAFAASIGQPFSFHQCRLDSDETFRPSALKLVKGEALVINCMLNLPHFGYRSPDSIASFLSGAKTLNPRLVTLVEEEVRPTGDGGFVARFMDSLYHYSAVYDSLEAGFPMQSRARALVERVFLGPRIAGSLARIYRANGEVGCSWSEWLGAVGFKPMPISFANHCQAKLLLGLFNDGYRVEEVSNHRLVLGWKSRCLLSASIWTSPSESDFVN

SEQ ID NO: 174 - protein, 516 aa, Triticum aestivum
MNYHEQEDQGLAVVATNNDGLDWLEDSVSLLAGDIDLGGSYGWWCDILPAQKDDIGSVVAQTLSPPAPPATSSPLAHPSPSIASPAASEPSPKKRKSPARVVSGSGHSSSNNQRRRTEQDRPGGGKKGGGAGSDRDARWAEQLLGPCAVAVEARNLSRVQHLFYVLGELAAFSGDANHRLAAYGLRALSLRLPAAVGPAAAAAVRVPAACESPTPSFAGAEPRLFRASLIKFHEVSPWFTLPNTLANAAISQLASAAPRPLHLVDIGVSHGVQWPTLLESLTRMAAGRAPPSVRLTVVATPPVPFSASPPGYDFAPHLLRYAKSIKLDLEIGRAASLDPAHGLCTTPDEALVVCLQFRLGHVSAEERADIIRRVKDLKPHLVVLSELDVGGNGSAAGEFTARLELLWRFLESTHAAFKGRDGEDRRLLEAEAGTAVAVAAAREAMGREGWRDRMAAAGFDQVAFGGEAVESARSLLRKYDNGWEMSTAAAATGGGGAVALRWKGQPVSFCSLWRPA

SEQ ID NO: 175 - protein, 561 aa, Triticum aestivum
MDVTMEDVVGDLEISGYSSISTSPSSSLDDGMGLYGWNALSPVADWGLFSSDDGGHDLHGLIESMLCDDALIGKPDEHPTMFTDGPCYSNASEPSSTTTTNPGTPVQHDDTPDCNPEKGLRLLHLLMAAAEALSGPHKSRELARVILVRLKEMVSSTSGNAGASNMERLAAHFTDALQGLLDGSHSVAGTSRQAAMAASHHHSTGDVLTAFQMLQDMSPYMKFGHFTANQAILEAVAGDRRVHIVDYDLAEGIQWASLMQAMTSRPDGVSPPHLRITAITRSGGGGARAVQEAGRRLAAFAGSIGQPFSFGHCRLDSDERFRPATVRMVKGETLVANCILHQAAATTTVRRPTGSVASFLTGMASLGAKVVTVVEEEGEAEKNEEEASDAAAGGFVGRFMEELHRYSAVWDSLEAGFPTQSRVRGLVERVILAPNIAGAVSRAYRGTDGEGRRGWGEWMRGSGFEMVPLSCFNHSQARLLLGLFNDGYTVEETRPNKIVLGWKARRLLSASVWAPPPLSVPSSPADGVCQPMGMAPSSGGFGRTEYDYVDSFLVEPAYALV

SEQ ID NO: 176 - protein, 558 aa, Solanum tuberosum
MTKHQNILSHHNFCDTMTIEEPEPNSNSDPISEWLASTLSDVPSFLDEPYSYTDDLNFYADSWWVPDQDDQIVNHNIIIDNTCNSFNISSPVNTAISNIPLEPIILDQPQPVDLSKKRKISDQNPKTSKKNHNRQINEAENAHTIGDQGGVQVRRPKRVTTKSTGNNSNNKEGRWAEHLLNPCAAAITVGNMNRVQHLLYVLHELASFTGDANHRLAAHGLRALTHHLSSPGSSSASSGTIGVTNFSSANHKFFRDSLINFIDISPWFRIPNNIANSSVLQIIGEQDRLKNLHILDIGVSHGFQWPTLLEELTRRSGGPPPLVRLTVITPTTENGELRGTPFVIGPPGYDFSSQLLAYAKAININLQINRLDNFPLQNLNSQIINSTSDETLVICAQFRLHNLNHTIPDDRTDLLKILKSLDPKGLVLSENNTECSCNSCGDFATMFSRRVEYLWRFLDSTSVAYKGRESEERKMMEGEAAKALTNMGEMNERKEKWCERMRNVGFVKEVFGEDAIDGARALLRKYDSNWEMRVEEKDGCVDLWWKGQPISFCSLWKI

SEQ ID NO: 177 - protein, 554 aa, Medicago truncatula
MTMEPNPTSDHILDWLEGSVSFFPSFLDDPYNNGYIHEYEIWNQNQDISNQYQIDANTNSSNATNSTTNIVAASTTTSTTSLEPNSFNNIPFSDLPKKRNAEDELSLKKQPQNQKNKRLKSRPMNESDNGDAALEGTVVRKSGGNKKGAAKANGSNSNNGNNKDGRWAEQLLNPCAVAITGGNLNRVQHLLYVLHELASTTGDANHRLAAHGLRALTHHLSSSSSSTPSGTITFASTEPRFFQKSLLKFYEFSPWFSFPNNIANASILQVLAEEPNNLRTLHILDIGVSHGVQWPTFLEALSRRPGGPPPLVRLTVVNASSSTENDQNMETPFSIGPCGDTFSSGLLGYAQSLNVNLQIKKLDNHPLQTLNAKSVDTSSDETLIVCAQFRLHHLNHNNPDERSEFLKVLRGMEPKGVILSENNMECCCSSCGDFATGFSRRVEYLWRFLDSTSSAFKNRDSDERKMMEGEAAKALTNQREMNERREKWCERMKEAGFAGEVFGEDAIDGGRALLRKYDNNWEMKVEENSTSVELWWKSQPVSFCSLWKLDKQPE

SEQ ID NO: 178 - protein, 554 aa, Medicago truncatula; identical to SEQ ID NO: 177

SEQ ID NO: 179 - protein, 425 aa, Oryza sativa
MDMEHELRGGGVGAAAHGHGSICFSGGPVLVDGRRIQQLLLHCAAALESNDVTLAQQAMWVLNNIASSQGDPSQRLTSWLLRALVARACRLCAAAPAGAAVEFLERGRAPPWGRAMSVTELADYVDLTPWHRFGFTASNAAILRAVAGASAVHVVDLSVTHCMQWPTLIDVLSKRPGGAPAIRITVPSVRPAVPPLLAVSSSELGARLAIFAKSKGVQLEFNVVESATTTSPKKTSTTLCQELASVLSDPPSLGLRDGEAVVVNCQSWLRHVAPDTRDLFLDTVRALNPCLLTVTDEDADLGSPSLASRMAGCFDFHWILLDALDMSAPKDSPRRLEQEAAVGRKIESVIGEEDGAERSEPGARLAERMSRKGFAGVVFDEEAAAEVRRLLSEHATGWGVKREDDMLVLTWKGHAAVFTGAWTPN

SEQ ID NO: 180 - protein, 415 aa, Hordeum vulgare
MEQELRSGGAVRAQSTMCFSGALVDGPRIQQLLLHCAAALESNDVTLAQQAMWVLNNIASAQGDPNQRLTSSLLRGLVARACRTCGSPRADSMGPPPALGSQRAMSVTELADYVDLTPWHRFGFTASNGAILRAVAGRNAVHVVDLGVTRCMQWPTLIDALSKRPGGAPALRITVPSVRPAGPPLLGVPDEEIGLRLANFAKSKGVQLEFNVVNKSTATSTPSPAKLQTVCQELGSVLSDPPALRLRDSEALVVNCQSWLRHVAPGSRDGFMDAVRALDPCLVTVTDEDADLDSPSLATRIAGCFNFHWILFDALDTSAPRDSPRRLEHEAAVGQKIESVVGADGTERSESGARLAERMRRKGFAGVGFGEDEVAEVRHLLSEHATGWGVKREEDMLVLTWKGHAAVFTTAWAPN

SEQ ID NO: 181 - protein, 507 aa, Medicago truncatula
MNVMDYEQFDYSFTPPYMNQLHECSLENLSPLQAEDLLFPNTILDEILFDQDQSQYLSSPNTILDEIFDQEESMQGLLQQHTNLDFNIINHEQAMALEYELCGGVTEKGRENVFVSREKDSYWKEVQEELMEETSLVDLLLIGAEAAESQNMTLASDIIEKLNNASSVGKGDSLLNRLCLFFTQGLYYKTTNAPKFHSEHVSTQTSTFCVFQILQELSPYVKFAHFTANQAIFEATAGVEDVHVIDFDIMEGIQWPPLMVDFAMRKKTTSLRVTAITVDLQSEASVQQTGRRLKEFADSINFPFTFDTVMMVSEEDFKEIELGETFIVNCMIHQWMPNRSFSLVKAFLDCVTKSSPRLVVLVEEELFNFSRLKSMSFVEFFCEALHHYIAVSDSLVSTLSRSHKMELALIEKEVLGNRILDSVRQFPCEKEERILWEGRFFYSLKGYKRVGMSTCNISQAKLLVSLFGKGYWVQFENCKLALCWKSRPLTSVSIWVPTDYNMSDKVK

SEQ ID NO: 182 - protein, 462 aa, Oryza sativa
METMSYPCSLLIPFSTQFEEISSSSLLLWSPQAEENPHENANMYEFDADHSHDQIHQDHQFLDMMVIQESANEFDGNHSHDQIHQDHEFLETMVIQESANEFDGDHSHDQIHQDHEFLEMMAIQESANDLLQLQDDFSVPNADPLAASFEFDERLAVAGHENGNVVATQEESAGDLLLAGAMAVDAGDAVHASAIMSRLDDLLADIAGRRSCEATSPVDHLAYYFARGLKLRISGAATPASSPPPPAANWSSPAYRMLQELTPFVKFAHFTANQAILEATADDLDVHVVDFNVGEGVQWSSLMLKLLLLGTITILQPKLVILIEDELSRISKNPPSPSLAAPPPFPEFFSDAVAHFTAVMESTASCLVSYDDEAWLSLRRVGEEVVGPRVEDAVGRYGSLAGGAQMMEGLRAREVSGFSVAQGKMLAGLFGGGFGVVHQEKGRLALCWKSRPLISVSLWCPK

SEQ ID NO: 183 - protein, 472 aa, Oryza sativa
MVLDSNELHQHDAPDVDVSINCDDRIFGQESVNLAAIQEELLEEDSLSDLLLAGAEAVEAGDSILASVAFSRLDDFLSGIPENGAASSFDRLAYHFDQGLRSRMSSASTGCYQPEPLPSGNMLVHQIIQELSPFVKFAHFTTNQAILDAIIGDMDVHVVDLNIGEGIQWSSLMSDLARCGGKSFRLTAITTYADCHASTHDTVVRLLSEFADSLELPFQYNSICVHNEDELHAFFEDCKGSVIVSCDTTSMYYKSLSTLQSLLLVCVKKLQPKLVVTIEEDLVRIGRGVSPSSASFVEFFFEALHHFTTVFESMASCFIGSSYEPCLRLVEMELLGPRIQDFVVKYGSVRVEANASEVLEGFMACELSACNIAQARMLVGLFNRVFGVVFKKISLLMVYYISLGKNDLREPNKVIWSSLAAGCGSHGIVVLAFYAADKLLEFKPKGIETYIHPAVERAHFHKEDRMWQEYEN

SEQ ID NO: 184 - protein, 474 aa, Hordeum vulgare
METMSYPCSPLLSLPTHEESNFFIWSPQVALHENATIHVDHSTDQQHDNVFLDTAAQHYANDWQQQDASDVGVFTYCGERILGQESGNLVAIQEELMEENSLTDLLLTGAEAVEAGDPRFALAVFSRLDGLLLGTPENAAAGSFDRLAYHFSQGLRSRISSASTSCSPPEPLASDRMSVQQIIQELSPFAKFAHFTANQAILDATKGDAHVHVVDLNIGEGIQWPSLMSDLARHGGISFHLTAVTADADYSDAVHHASARWLSEFAESLNLPFQYSSLCLHSDEDLHEFSKNSKGSVIFSCDTTSMPYKLLSKLPALLPACVELLQPKLMVIIEEELVRIGKEVSLCKASFVDFFFEALHHFTTVFESLASCFAGGNQGVCLRLVEREMVGPRIQDFVGQYGSVTAEVNAPVVLERYGACDLSGCNVAQARMLVGLFNRGFEIVHEKGRLMLCWKSRPLTSVSVWAPILKERSS

SEQ ID NO: 185 - protein, 506 aa, Medicago truncatula
MEIHDMDIDIDMIMDVVPDFLEFSNQSNTTTPPTSDDDTTWSPLLDLDFFTTNQDDFHNFIDSLTNDEITPVAPNLDNKVVEQDDEEEEEDGSMGDMSNSNSTTEEEEDDRKGLRLVHLLMAAAEALTGTNKSHHLAQVILIRLKDLVSSTHGTNMERLAAYFTDALQTLLNGTDCGGHHKLCLLTGPHQTDILSAFQLLQDMSPYVKFAHFTANQAILEAVTHERRVHIVDFDIMEGAQWASLIQSLSSRKEGLPGPHLRITALSRNKERGNGRSRSSFATVQETGRRLTTFAASVGQPFTFHQCRLESDERFRTSSLKLVRGEALVFNCVMHLPHLSYRASDSIASFLNGAKELGTKLVTLVEEEVGPITDAGFVGLFMDSLHRYSAMYDSFEAGFPMNKWARSLVEQVFLGPRIMGSVAQLYMTGEEEEQERGSWGEWLGVEGFRGVNISYGNHCQAKLLLGLFNDGYRVEELGNNKLVLGWKSRRLLSASVWTCMSEIEYDF

SEQ ID NO: 186 - protein, 508 aa, Medicago truncatula; identical to SEQ ID NO: 141

SEQ ID NO: 187 - protein, 585 aa, Medicago truncatula
MSQQEILHTPWPLIYEHMDSSTFDHHHHHQVIEPYSFTMVDHVDDYDPYGIIMDDHVDVDYVPYGIIMDDHVEYDYEFNTLLSTSENSTLSEISIFTNDHIQFPIDEETLELPSLMELDSILSPQTGNIHEQEYYQEESEGSFPSQNFPHNLEGQISNPLGDSCKMAASATYDHFPSQNSPCDAWSPTLSMKSDFSSIQQSLTLPQENMEIENQVSLPHLMEAHGEALEKGQRALAEVNLKCISQKVTTPIGDSLETLAFYLAQEVTNHGEYLKGEAYKNFQAAFKVFYQGNLVGKIAHFSAISSILEAAMLEDCDEIHIIDYCLGNGVQWPFLLEAVSKMNKRLKLTSIKWSDENSERVWNFEDTKRELYEYAKSCGLILKVEEKELEQLSSELKIMNETGGKKEFLAFNLMTGLPHMGMVRRRRKHAYEFLKVAEDLIKNYGIKGIITFGDGDAFEKLKNSLNFMSFFEGNLVHYKALLESIESQFSTKFSEARIACEVLFVAPCISSLDWLQTWEEMKSDGYVKDEISIDGGRLSKNVLMEVREMLRGSDSSYQARIEGENENQLVLEWKGSQLLRFSIWKN

SEQ ID NO: 188 - DNA, 23 bp, Artificial Sequence
  Synthetic Construct
gacggcggccacgacctccacgg

SEQ ID NO: 189 - DNA, 23 bp, Artificial Sequence
  Synthetic Construct
gtgaccatggaggacgtggtggg

SEQ ID NO: 190-206 - skipped (17 entries)

SEQ ID NO: 207 - protein, 665 aa, Artificial Sequence
  Synthetic Construct
  VARIANT 1: Xaa = M, or none
  VARIANT 2: Xaa = T, or none
  VARIANT 3: Xaa = K, or none
  VARIANT 4: Xaa = H, or none
  VARIANT 5: Xaa = Q, or none
  VARIANT 6: Xaa = N, or none
  VARIANT 7: Xaa = I, or none
  VARIANT 8: Xaa = L, or none
  VARIANT 9: Xaa = S, or none
  VARIANT 10: Xaa = H, or none
  VARIANT 11: Xaa = H, or none
  VARIANT 12: Xaa = N, or none
  VARIANT 13: Xaa = F, or none
  VARIANT 14: Xaa = C,M, or none
  VARIANT 15: Xaa = D,K, or none
  VARIANT 16: Xaa = T,P, or none
  VARIANT 17: Xaa = M, or none
  VARIANT 18: Xaa = T,S,N, or none
  VARIANT 19: Xaa = I,L,Y,N,C, or none
  VARIANT 20: Xaa = M,E,H, or none
  VARIANT 21: Xaa = T,I,E,R,P, or none
  VARIANT 22: Xaa = M,P,E,Q, or none
  VARIANT 23: Xaa = E,S,Q, or none
  VARIANT 24: Xaa = R,D,Q,H, or none
  VARIANT 25: Xaa = H,Q,P,A, or none
  VARIANT 26: Xaa = G,E, or none
  VARIANT 27: Xaa = L, or none
  VARIANT 28: Xaa = A, or none
  VARIANT 29: Xaa = P,V, or none
  VARIANT 30: Xaa = N,V,E,A, or none
  VARIANT 31: Xaa = P,L,H,S,A,T, or none
  VARIANT 32: Xaa = T,I,N,A, or none
  VARIANT 33: Xaa = S,P,N,A,T, or none
  VARIANT 34: Xaa = D,G,N,A, or none
  VARIANT 35: Xaa = H,N,P,D,T,S, or none
  VARIANT 36: Xaa = I,S,G,T, or none
  VARIANT 37: Xaa = L,S,F, or none
  VARIANT 38: Xaa = D,E, or none
  VARIANT 39: Xaa = W,C, or none
  VARIANT 40: Xaa = L,F, or none
  VARIANT 41: Xaa = E,A,D, or none
  VARIANT 42: Xaa = G,D,E,S,A, or none
  VARIANT 43: Xaa = S,T,P, or none
  VARIANT 44: Xaa = V,A,M,L,I, or none
  VARIANT 45: Xaa = S,A, or none
  VARIANT 46: Xaa = F,Y,S,D,L, or none
  VARIANT 47: Xaa = F,L,V, or none
  VARIANT 48: Xaa = L,P, or none
  VARIANT 49: Xaa = A,L,T, or none
  VARIANT 50: Xaa = P,A,G, or none
  VARIANT 51: Xaa = S,P,D,N, or none
  VARIANT 52: Xaa = F,L, or none
  VARIANT 53: Xaa = L,F,V,I, or none
  VARIANT 54: Xaa = D, or none
  VARIANT 55: Xaa = D,Y,L,E,I,A, or none
  VARIANT 56: Xaa = P, or none
  VARIANT 57: Xaa = S,A,Y, or none
  VARIANT 58: Xaa = N,G,S, or none
  VARIANT 59: Xaa = Y,G, or none
  VARIANT 60: Xaa = N,D,S,G,T, or none
  VARIANT 61: Xaa = N,S,G,D, or none
  VARIANT 62: Xaa = G,S,D, or none
  VARIANT 63: Xaa = A,L, or none
  VARIANT 64: Xaa = Y,D,G,N, or none
  VARIANT 65: Xaa = I,V,G,F,A,C, or none
  VARIANT 66: Xaa = H,Q,N,Y,G, or none
  VARIANT 67: Xaa = E,D,G,S,A, or none
  VARIANT 68: Xaa = Y,C,D, or none
  VARIANT 69: Xaa = E,Q,A,S,G, or none
  VARIANT 70: Xaa = I,L,T,W, or none
  VARIANT 71: Xaa = W,N,P, or none
  VARIANT 72: Xaa = N,E,C,W,V,S, or none
  VARIANT 73: Xaa = Q,R,A,P,D, or none
  VARIANT 74: Xaa = N,Y,T,A,D,I,S, or none
  VARIANT 75: Xaa = Q,E,S,P, or none
  VARIANT 76: Xaa = D,E,P,L,A, or none
  VARIANT 77: Xaa = T,A,D,P,Q, or none
  VARIANT 78: Xaa = A,Q,E, or none
  VARIANT 79: Xaa = I,V,Q,R, or none
  VARIANT 80: Xaa = S,A,T,E,C,Q,V,K,H, or none
  VARIANT 81: Xaa = N,S,P,Q,D, or none
  VARIANT 82: Xaa = Q,N,H,G,D, or none
  VARIANT 83: Xaa = Y,R,M,L,P,I,N,V, or none
  VARIANT 84: Xaa = Q,P,L,S,I,G,R, or none
  VARIANT 85: Xaa = H,S, or none
  VARIANT 86: Xaa = I,T,L,S,N,V,M, or none
  VARIANT 87: Xaa = D,I,L,T,N,V, or none
  VARIANT 88: Xaa = A,T,N,D,V, or none
  VARIANT 89: Xaa = N,E,A,Q, or none
  VARIANT 90: Xaa = T,P,S, or none
  VARIANT 91: Xaa = N,S,H,L,C, or none
  VARIANT 92: Xaa = S,R,N,A, or none
  VARIANT 93: Xaa = S,P, or none
  VARIANT 94: Xaa = N,P,A,S,F,T, or none
  VARIANT 95: Xaa = A,N,L,T,S, or none
  VARIANT 96: Xaa = T,A,Q,S,I, or none
  VARIANT 97: Xaa = N,T,P,R,A,S, or none
  VARIANT 98: Xaa = S,N,K,A,L, or none
  VARIANT 99: Xaa = T,P,H,L, or none
  VARIANT 100: Xaa = T,I,A,V,Q, or none
  VARIANT 101: Xaa = A,P,T, or none
  VARIANT 102: Xaa = P,S,N, or none
  VARIANT 103: Xaa = P,V,A, or none
  VARIANT 104: Xaa = L,Y,C,R,T,P, or none
  VARIANT 105: Xaa = N,A,T,K,S, or none
  VARIANT 106: Xaa = I,L,S,F,A, or none
  VARIANT 107: Xaa = V,A,P,T,K,D, or none
  VARIANT 108: Xaa = A,H,L,K,E,N,I, or none
  VARIANT 109: Xaa = A,F,L,P,S, or none
  VARIANT 110: Xaa = S,H,L,T,I,D,A,N,V, or none
  VARIANT 111: Xaa = T,P,R,K,A, or none
  VARIANT 112: Xaa = T,V,S,R,Y,N,A, or none
  VARIANT 113: Xaa = T,P,G,R,I,A, or none
  VARIANT 114: Xaa = S,I,T,R,N, or none
  VARIANT 115: Xaa = T,I,L,N,S, or none
  VARIANT 116: Xaa = T,A,C,H,R,N,I,S, or none
  VARIANT 117: Xaa = S,P,A,E, or none
  VARIANT 118: Xaa = L,P,A, or none
  VARIANT 119: Xaa = E,S, or none
  VARIANT 120: Xaa = T,S,L,D,N,P, or none
  VARIANT 121: Xaa = P,C,R,M, or none
  VARIANT 122: Xaa = N,D,A,E,R,H,T,I,M,V, or none
  VARIANT 123: Xaa = S,A,C,R,L,T,I,V, or none
  VARIANT 124: Xaa = F,N,S,L, or none
  VARIANT 125: Xaa = N,D, or none
  VARIANT 126: Xaa = N,H,Q, or none
  VARIANT 127: Xaa = I,L,Q,P, or none
  VARIANT 128: Xaa = P,Q,E, or none
  VARIANT 129: Xaa = F,L,P, or none
  VARIANT 130: Xaa = S,V, or none
  VARIANT 131: Xaa = D,S,R,N,G, or none
  VARIANT 132: Xaa = L,E,R,S,Q, or none
  VARIANT 133: Xaa = P,G,R,S, or none
  VARIANT 134: Xaa = K,S,C,L,R, or none
  VARIANT 135: Xaa = K,P,N,R,D,S, or none
  VARIANT 136: Xaa = R,G,V,K, or none
  VARIANT 137: Xaa = N,S,K,A,Q,G,E,P, or none
  VARIANT 138: Xaa = A,R,C,L,S,I, or none
  VARIANT 139: Xaa = E,T,A,S, or none
  VARIANT 140: Xaa = D,G,T, or none
  VARIANT 141: Xaa = E,D,Q,N, or none
  VARIANT 142: Xaa = L,N,D, or none
  VARIANT 143: Xaa = S,K,A,P, or none
  VARIANT 144: Xaa = L,S,C,V,K, or none
  VARIANT 145: Xaa = K,P,A,S,T,L, or none
  VARIANT 146: Xaa = K,V,A,Q,R, or none
  VARIANT 147: Xaa = Q,P,R,M,T,H, or none
  VARIANT 148: Xaa = P,L,S, or none
  VARIANT 149: Xaa = Q,V,A,H,K, or none
  VARIANT 150: Xaa = N,G,A,V,L,H,K, or none
  VARIANT 151: Xaa = S,G,H,R, or none
  VARIANT 152: Xaa = Q,H,G,A, or none
  VARIANT 153: Xaa = K,S,R,Q,G, or none
  VARIANT 154: Xaa = N,H,G,R,Y,A, or none
  VARIANT 155: Xaa = K,Q,H,S, or none
  VARIANT 156: Xaa = R,K,G,A,S,Q,T, or none
  VARIANT 157: Xaa = S,T,E,G, or none
  VARIANT 158: Xaa = L,I,G,S,T,R,Q, or none
  VARIANT 159: Xaa = K,N, or none
  VARIANT 160: Xaa = S,Q,K,H,N, or none
  VARIANT 161: Xaa = R,K,Q,N, or none
  VARIANT 162: Xaa = R,G,H,I, or none
  VARIANT 163: Xaa = P,R,W,K,Q,T, or none
  VARIANT 164: Xaa = M,R,I,S,A, or none
  VARIANT 165: Xaa = N,D,S,E, or none
  VARIANT 166: Xaa = E,N,A,S,Q, or none
  VARIANT 167: Xaa = S,E,F,A, or none
  VARIANT 168: Xaa = D,A,S,E, or none
  VARIANT 169: Xaa = N,D,Y,Q, or none
  VARIANT 170: Xaa = G,N,T,S,D,P, or none
  VARIANT 171: Xaa = D,G,S,A, or none
  VARIANT 172: Xaa = D,H,E, or none
  VARIANT 173: Xaa = A,T, or none
  VARIANT 174: Xaa = E,I, or none
  VARIANT 175: Xaa = A,G,E, or none
  VARIANT 176: Xaa = A,T,Q, or none
  VARIANT 177: Xaa = A,T,M,V,R, or none
  VARIANT 178: Xaa = L,T,G,I,V,A,K,R, or none
  VARIANT 179: Xaa = E,T,M,P,G, or none
  VARIANT 180: Xaa = G,T,E,W,V,D, or none
  VARIANT 181: Xaa = T,A,Q,I,V,H, or none
  VARIANT 182: Xaa = V,T,E,S,A,G, or none
  VARIANT 183: Xaa = V,L,Q,R,G,C, or none
  VARIANT 184: Xaa = R,D,S,K,G,V,A, or none
  VARIANT 185: Xaa = K,S,R,G,Q, or none
  VARIANT 186: Xaa = S,G,P,V,K, or none
  VARIANT 187: Xaa = G,Y,N,R,K, or none
  VARIANT 188: Xaa = G,A,P,R,V, or none
  VARIANT 189: Xaa = N,G,K,P,S, or none
  VARIANT 190: Xaa = K,R,N,A,G, or none
  VARIANT 191: Xaa = K,E,A,R, or none
  VARIANT 192: Xaa = G,V,I,A, or none
  VARIANT 193: Xaa = A,G,R,N,H,T, or none
  VARIANT 194: Xaa = A,S,G,T, or none
  VARIANT 195: Xaa = K,Q,H, or none
  VARIANT 196: Xaa = A,S,G, or none
  VARIANT 197: Xaa = N,T,S,V,G, or none
  VARIANT 198: Xaa = G,M,V,I,A,S,K, or none
  VARIANT 199: Xaa = S,N,C,G,K, or none
  VARIANT 200: Xaa = N,F,G,A,T, or none
  VARIANT 201: Xaa = S,G,A, or none
  VARIANT 202: Xaa = N,G,R,A, or none
  VARIANT 203: Xaa = N,A,G, or none
  VARIANT 204: Xaa = G,C,P,S,T, or none
  VARIANT 205: Xaa = N,S,V,L, or none
  VARIANT 206: Xaa = N,L,D, or none
  VARIANT 207: Xaa = K,V,R, or none
  VARIANT 208: Xaa = D,R,E, or none
  VARIANT 209: Xaa = G,A,R,M,T, or none
  VARIANT 210: Xaa = R,P, or none
  VARIANT 211: Xaa = W,R, or none
  VARIANT 212: Xaa = A,I,G, or none
  VARIANT 213: Xaa = E,Q,A, or none
  VARIANT 214: Xaa = Q,D,H, or none
  VARIANT 215: Xaa = L,P, or none
  VARIANT 216: Xaa = L,V,P, or none
  VARIANT 217: Xaa = N,L,G,P, or none
  VARIANT 218: Xaa = P,H,R, or none
  VARIANT 219: Xaa = C,A, or none
  VARIANT 220: Xaa = A,T, or none
  VARIANT 221: Xaa = P, or none
  VARIANT 222: Xaa = L, or none
  VARIANT 223: Xaa = L, or none
  VARIANT 224: Xaa = V,A,R, or none
  VARIANT 225: Xaa = A, or none
  VARIANT 226: Xaa = I,L,V,F,R, or none
  VARIANT 227: Xaa = T,E,R, or none
  VARIANT 228: Xaa = G,S,A,T,I,V, or none
  VARIANT 229: Xaa = G,N,R, or none
  VARIANT 230: Xaa = N,D,G, or none
  VARIANT 231: Xaa = L,V,F,M, or none
  VARIANT 232: Xaa = N,T,S,L,P, or none
  VARIANT 233: Xaa = R,L,H, or none
  VARIANT 234: Xaa = V,A,R,T, or none
  VARIANT 235: Xaa = Q,R, or none
  VARIANT 236: Xaa = H,Q, or none
  VARIANT 237: Xaa = L,A,P,F, or none
  VARIANT 238: Xaa = L,S,M,F, or none
  VARIANT 239: Xaa = Y,W, or none
  VARIANT 240: Xaa = V, or none
  VARIANT 241: Xaa = L, or none
  VARIANT 242: Xaa = H,N,G, or none
  VARIANT 243: Xaa = E,N, or none
  VARIANT 244: Xaa = L,I, or none
  VARIANT 245: Xaa = A,Q,E, or none
  VARIANT 246: Xaa = S,A, or none
  VARIANT 247: Xaa = T,P,A,F,C,S, or none
  VARIANT 248: Xaa = T,Q,S,R,A, or none
  VARIANT 249: Xaa = G,R,V, or none
  VARIANT 250: Xaa = D,H,R, or none
  VARIANT 251: Xaa = A,P, or none
  VARIANT 252: Xaa = N,K,A,S, or none
  VARIANT 253: Xaa = H,Q,S, or none
  VARIANT 254: Xaa = R,A, or none
  VARIANT 255: Xaa = L, or none
  VARIANT 256: Xaa = A,T, or none
  VARIANT 257: Xaa = A,S,F, or none
  VARIANT 258: Xaa = H,S,Y,P,F,W, or none
  VARIANT 259: Xaa = G,L,P, or none
  VARIANT 260: Xaa = L,C, or none
  VARIANT 261: Xaa = R,K,Q, or none
  VARIANT 262: Xaa = A,G,S, or none
  VARIANT 263: Xaa = L,W, or none
  VARIANT 264: Xaa = T,V,S,N,A, or none
  VARIANT 265: Xaa = H,Q,A,L,R, or none
  VARIANT 266: Xaa = H,R,W, or none
  VARIANT 267: Xaa = L,A,P, or none
  VARIANT 268: Xaa = S,C,P,R, or none
  VARIANT 269: Xaa = S,R,A,T,G,H, or none
  VARIANT 270: Xaa = S,T,A,R,L,P, or none
  VARIANT 271: Xaa = S,P,C,V,R,T,G,L, or none
  VARIANT 272: Xaa = S,T,G,A, or none
  VARIANT 273: Xaa = S,P,R,A,Q, or none
  VARIANT 274: Xaa = P,A,E,S, or none
  VARIANT 275: Xaa = R,A,G,P, or none
  VARIANT 276: Xaa = A,S,L, or none
  VARIANT 277: Xaa = S,D,A,G, or none
  VARIANT 278: Xaa = S,A,R,T, or none
  VARIANT 279: Xaa = M,V,A, or none
  VARIANT 280: Xaa = G,R,V,K, or none
  VARIANT 281: Xaa = V,E, or none
  VARIANT 282: Xaa = P, or none
  VARIANT 283: Xaa = A,P, or none
  VARIANT 284: Xaa = A,C, or none
  VARIANT 285: Xaa = T,C,A,S,G, or none
  VARIANT 286: Xaa = P,S,E,R,F,T, or none
  VARIANT 287: Xaa = S,C,V,I,L,R, or none
  VARIANT 288: Xaa = G,P,L,E, or none
  VARIANT 289: Xaa = T,S,P,D,R,V, or none
  VARIANT 290: Xaa = I,P,A,G,T,M,S, or none
  VARIANT 291: Xaa = T,P,S,V,R,A,N, or none
  VARIANT 292: Xaa = F,A,I, or none
  VARIANT 293: Xaa = A,L,R,T,P,S, or none
  VARIANT 294: Xaa = S,G,R,A,P, or none
  VARIANT 295: Xaa = T,A,S,I,W,V, or none
  VARIANT 296: Xaa = E,Q,G,N,D, or none
  VARIANT 297: Xaa = P,R,H, or none
  VARIANT 298: Xaa = R,A,K, or none
  VARIANT 299: Xaa = F,M,L, or none
  VARIANT 300: Xaa = F,S,L, or none
  VARIANT 301: Xaa = Q,V,R,H, or none
  VARIANT 302: Xaa = K,T,A,R,D, or none
  VARIANT 303: Xaa = S,T,E, or none
  VARIANT 304: Xaa = L, or none
  VARIANT 305: Xaa = L,A,I,V, or none
  VARIANT 306: Xaa = K,D,R,N, or none
  VARIANT 307: Xaa = F,Y, or none
  VARIANT 308: Xaa = Y,V,H,I,N, or none
  VARIANT 309: Xaa = E,D, or none
  VARIANT 310: Xaa = F,V,L,I, or none
  VARIANT 311: Xaa = S,T,C, or none
  VARIANT 312: Xaa = P,S, or none
  VARIANT 313: Xaa = W, or none
  VARIANT 314: Xaa = F,H, or none
  VARIANT 315: Xaa = S,R,T,M,A, or none
  VARIANT 316: Xaa = F,L,I,V, or none
  VARIANT 317: Xaa = P,G,L, or none
  VARIANT 318: Xaa = N,F, or none
  VARIANT 319: Xaa = N,T,A, or none
  VARIANT 320: Xaa = I,A,L, or none
  VARIANT 321: Xaa = A,S, or none
  VARIANT 322: Xaa = N, or none
  VARIANT 323: Xaa = A,G,S, or none
  VARIANT 324: Xaa = S,A, or none
  VARIANT 325: Xaa = I,V, or none
  VARIANT 326: Xaa = L,S,A, or none
  VARIANT 327: Xaa = Q,R, or none
  VARIANT 328: Xaa = V,A,L,I, or none
  VARIANT 329: Xaa = L,V,S,I,A, or none
  VARIANT 330: Xaa = A,G,T,S, or none
  VARIANT 331: Xaa = E,Q,C,R, or none
  VARIANT 332: Xaa = E,D,Q,K, or none
  VARIANT 333: Xaa = G,K, or none
  VARIANT 334: Xaa = A,G, or none
  VARIANT 335: Xaa = P,T,A,L,D,N, or none
  VARIANT 336: Xaa = D,S,G,V, or none
  VARIANT 337: Xaa = N,A,P, or none
  VARIANT 338: Xaa = N,G,A,H,T,R,E, or none
  VARIANT 339: Xaa = L,S,R,P,K,A, or none
  VARIANT 340: Xaa = R,N,Q,S,K, or none
  VARIANT 341: Xaa = T,A,P,S,N,Q, or none
  VARIANT 342: Xaa = L,V, or none
  VARIANT 343: Xaa = H, or none
  VARIANT 344: Xaa = I,V,L, or none
  VARIANT 345: Xaa = L,V,I, or none
  VARIANT 346: Xaa = D, or none
  VARIANT 347: Xaa = I,L, or none
  VARIANT 348: Xaa = G,D,S, or none
  VARIANT 349: Xaa = V,A, or none
  VARIANT 350: Xaa = S,T, or none
  VARIANT 351: Xaa = H,R, or none
  VARIANT 352: Xaa = G,C,E, or none
  VARIANT 353: Xaa = V,M,F, or none
  VARIANT 354: Xaa = Q,R, or none
  VARIANT 355: Xaa = W,L, or none
  VARIANT 356: Xaa = P, or none
  VARIANT 357: Xaa = T, or none
  VARIANT 358: Xaa = F,L, or none
  VARIANT 359: Xaa = L,I, or none
  VARIANT 360: Xaa = E,D, or none
  VARIANT 361: Xaa = A,S,P,V,E, or none
  VARIANT 362: Xaa = L,S, or none
  VARIANT 363: Xaa = S,T,P, or none
  VARIANT 364: Xaa = R,K,C,A, or none
  VARIANT 365: Xaa = R,M,W,Q,V,L, or none
  VARIANT 366: Xaa = P,A,Q,S, or none
  VARIANT 367: Xaa = P, or none
  VARIANT 368: Xaa = A,D,G,R, or none
  VARIANT 369: Xaa = G, or none
  VARIANT 370: Xaa = G,R,S, or none
  VARIANT 371: Xaa = P,A,R,T, or none
  VARIANT 372: Xaa = P,R, or none
  VARIANT 373: Xaa = P,L, or none
  VARIANT 374: Xaa = L,A,S,F, or none
  VARIANT 375: Xaa = V,L,G,I, or none
  VARIANT 376: Xaa = R, or none
  VARIANT 377: Xaa = L,I, or none
  VARIANT 378: Xaa = T, or none
  VARIANT 379: Xaa = V,L, or none
  VARIANT 380: Xaa = V,P,I,A, or none
  VARIANT 381: Xaa = N,T,S,A,G, or none
  VARIANT 382: Xaa = A,V,P, or none
  VARIANT 383: Xaa = S,T,G, or none
  VARIANT 384: Xaa = S,A, or none
  VARIANT 385: Xaa = S,T, or none
  VARIANT 386: Xaa = T,V,S, or none
  VARIANT 387: Xaa = E, or none
  VARIANT 388: Xaa = N,I, or none
  VARIANT 389: Xaa = D,A,G, or none
  VARIANT 390: Xaa = Q,T,E, or none
  VARIANT 391: Xaa = N,R,T,S,L,A, or none
  VARIANT 392: Xaa = M,P,T,R, or none
  VARIANT 393: Xaa = E,D,A,P,V,G, or none
  VARIANT 394: Xaa = T,G,V,A, or none
  VARIANT 395: Xaa = P, or none
  VARIANT 396: Xaa = F,P, or none
  VARIANT 397: Xaa = S,C,L,V, or none
  VARIANT 398: Xaa = I,L,A,V, or none
  VARIANT 399: Xaa = G,S,A, or none
  VARIANT 400: Xaa = P,V, or none
  VARIANT 401: Xaa = C,P,S, or none
  VARIANT 402: Xaa = G,D,S, or none
  VARIANT 403: Xaa = D,E,Y,S, or none
  VARIANT 404: Xaa = T,N,E,D, or none
  VARIANT 405: Xaa = F,I,L,C, or none
  VARIANT 406: Xaa = S,G,P,A, or none
  VARIANT 407: Xaa = S,L,P,T,A, or none
  VARIANT 408: Xaa = G,R,H,Q, or none
  VARIANT 409: Xaa = L, or none
  VARIANT 410: Xaa = L,A, or none
  VARIANT 411: Xaa = G,N,R,P,S,I,A, or none
  VARIANT 412: Xaa = Y,F, or none
  VARIANT 413: Xaa = A, or none
  VARIANT 414: Xaa = Q,K, or none
  VARIANT 415: Xaa = S,C,A,L, or none
  VARIANT 416: Xaa = L,M,K,I, or none
  VARIANT 417: Xaa = N,G,K,D,S, or none
  VARIANT 418: Xaa = V,L,I, or none
  VARIANT 419: Xaa = N,Q,D,R, or none
  VARIANT 420: Xaa = L,F, or none
  VARIANT 421: Xaa = Q,E,R,A, or none
  VARIANT 422: Xaa = I,F, or none
  VARIANT 423: Xaa = K,N,G,S,V, or none
  VARIANT 424: Xaa = K,V,R,Q, or none
  VARIANT 425: Xaa = L,V,A, or none
  VARIANT 426: Xaa = D,N,A,T,E,P, or none
  VARIANT 427: Xaa = N,K,S,T,C, or none
  VARIANT 428: Xaa = H,C,S,L,I,A,F, or none
  VARIANT 429: Xaa = P,T,D, or none
  VARIANT 430: Xaa = L,A,T, or none
  VARIANT 431: Xaa = Q,H,T, or none
  VARIANT 432: Xaa = T,S,K,N,D,P, or none
  VARIANT 433: Xaa = L,T,A,P,V, or none
  VARIANT 434: Xaa = N,P,H,V,S,R, or none
  VARIANT 435: Xaa = S, or none
  VARIANT 436: Xaa = P,K, or none
  VARIANT 437: Xaa = A,K, or none
  VARIANT 438: Xaa = K,T, or none
  VARIANT 439: Xaa = L,S, or none
  VARIANT 440: Xaa = Q,T, or none
  VARIANT 441: Xaa = T, or none
  VARIANT 442: Xaa = V,L, or none
  VARIANT 443: Xaa = C, or none
  VARIANT 444: Xaa = Q, or none
  VARIANT 445: Xaa = E, or none
  VARIANT 446: Xaa = L, or none
  VARIANT 447: Xaa = G,A, or none
  VARIANT 448: Xaa = S, or none
  VARIANT 449: Xaa = V, or none
  VARIANT 450: Xaa = L, or none
  VARIANT 451: Xaa = S, or none
  VARIANT 452: Xaa = A,D,G,S, or none
  VARIANT 453: Xaa = K,Q,P,F,L,T, or none
  VARIANT 454: Xaa = P,C,Y,A, or none
  VARIANT 455: Xaa = S,A,T,I,V,G,L, or none
  VARIANT 456: Xaa = V,L,A,I,M,D,T,S,P, or none
  VARIANT 457: Xaa = D,R,P,N,G,S, or none
  VARIANT 458: Xaa = T,A,L,S, or none
  VARIANT 459: Xaa = S,R,N,D,T, or none
  VARIANT 460: Xaa = S,P,D,G, or none
  VARIANT 461: Xaa = D,S,N,E,G, or none
  VARIANT 462: Xaa = E,K, or none
  VARIANT 463: Xaa = T,I,A, or none
  VARIANT 464: Xaa = L,F,R,V, or none
  VARIANT 465: Xaa = I,V, or none
  VARIANT 466: Xaa = V,I, or none
  VARIANT 467: Xaa = C,N, or none
  VARIANT 468: Xaa = A,C,L, or none
  VARIANT 469: Xaa = Q, or none
  VARIANT 470: Xaa = F,S, or none
  VARIANT 471: Xaa = R,W,L, or none
  VARIANT 472: Xaa = L, or none
  VARIANT 473: Xaa = H,R,G, or none
  VARIANT 474: Xaa = H,Q,N,L, or none
  VARIANT 475: Xaa = L,V,A, or none
  VARIANT 476: Xaa = N,A,T,S,G, or none
  VARIANT 477: Xaa = H, or none
  VARIANT 478: Xaa = N,T, or none
  VARIANT 479: Xaa = N,A,T,I,S, or none
  VARIANT 480: Xaa = P,A,T, or none
  VARIANT 481: Xaa = D,G,E, or none
  VARIANT 482: Xaa = E,S,T,D, or none
  VARIANT 483: Xaa = K, or none
  VARIANT 484: Xaa = S, or none
  VARIANT 485: Xaa = E, or none
  VARIANT 486: Xaa = R,K,Q, or none
  VARIANT 487: Xaa = S,D,T,M,R,A, or none
  VARIANT 488: Xaa = E,K,G,D,Y,L,A, or none
  VARIANT 489: Xaa = F,I,V,L, or none
  VARIANT 490: Xaa = L,M,I,F, or none
  VARIANT 491: Xaa = K,T,D,R, or none
  VARIANT 492: Xaa = V,A,R,F,I,T,K, or none
  VARIANT 493: Xaa = L,V,A, or none
  VARIANT 494: Xaa = R,K, or none
  VARIANT 495: Xaa = G,N,A,D,S, or none
  VARIANT 496: Xaa = M,L, or none
  VARIANT 497: Xaa = E,D,K,Q,N, or none
  VARIANT 498: Xaa = P, or none
  VARIANT 499: Xaa = K,C,Q,E,H, or none
  VARIANT 500: Xaa = G,L,R, or none
  VARIANT 501: Xaa = V,M,L, or none
  VARIANT 502: Xaa = I,T,V, or none
  VARIANT 503: Xaa = L,V,F, or none
  VARIANT 504: Xaa = S,T, or none
  VARIANT 505: Xaa = E,D,G, or none
  VARIANT 506: Xaa = N,E,L, or none
  VARIANT 507: Xaa = N,D, or none
  VARIANT 508: Xaa = M,L,A,V,T,S,G, or none
  VARIANT 509: Xaa = E,G,D,W, or none
  VARIANT 510: Xaa = C,L,V,R, or none
  VARIANT 511: Xaa = C,S,G,R, or none
  VARIANT 512: Xaa = C,V, or none
  VARIANT 513: Xaa = V, or none
  VARIANT 514: Xaa = G, or none
  VARIANT 515: Xaa = S,N,G, or none
  VARIANT 516: Xaa = S,C,D,G,N, or none
  VARIANT 517: Xaa = C,S,N,G,D, or none
  VARIANT 518: Xaa = G,P,D, or none
  VARIANT 519: Xaa = D,S,T, or none
  VARIANT 520: Xaa = F,L,A,V,T, or none
  VARIANT 521: Xaa = A,T, or none
  VARIANT 522: Xaa = T,G,S, or none
  VARIANT 523: Xaa = G,R,E,M, or none
  VARIANT 524: Xaa = F,I,S,M, or none
  VARIANT 525: Xaa = S,A,T, or none
  VARIANT 526: Xaa = R,G,A, or none
  VARIANT 527: Xaa = R,C, or none
  VARIANT 528: Xaa = V,F,L, or none
  VARIANT 529: Xaa = E,N,D, or none
  VARIANT 530: Xaa = Y,F,L, or none
  VARIANT 531: Xaa = L,H, or none
  VARIANT 532: Xaa = W, or none
  VARIANT 533: Xaa = R,I,Q,K, or none
  VARIANT 534: Xaa = F,L, or none
  VARIANT 535: Xaa = L,F, or none
  VARIANT 536: Xaa = D,E, or none
  VARIANT 537: Xaa = S,A, or none
  VARIANT 538: Xaa = T,L, or none
  VARIANT 539: Xaa = S,D,H,A, or none
  VARIANT 540: Xaa = S,T,A,E,M,V, or none
  VARIANT 541: Xaa = A,S,T, or none
  VARIANT 542: Xaa = F,A,Y, or none
  VARIANT 543: Xaa = K, or none
  VARIANT 544: Xaa = N,G,P, or none
  VARIANT 545: Xaa = R,K,M, or none
  VARIANT 546: Xaa = D,E, or none
  VARIANT 547: Xaa = S,G,V,A, or none
  VARIANT 548: Xaa = D,E,K, or none
  VARIANT 549: Xaa = E,D, or none
  VARIANT 550: Xaa = R,P, or none
  VARIANT 551: Xaa = K,R, or none
  VARIANT 552: Xaa = M,V,R,L,F, or none
  VARIANT 553: Xaa = M,L, or none
  VARIANT 554: Xaa = E, or none
  VARIANT 555: Xaa = G,H,A,Q, or none
  VARIANT 556: Xaa = E, or none
  VARIANT 557: Xaa = A, or none
  VARIANT 558: Xaa = A,G, or none
  VARIANT 559: Xaa = K,V,T,S,A, or none
  VARIANT 560: Xaa = A,G,I, or none
  VARIANT 561: Xaa = L,Q,V,R, or none
  VARIANT 562: Xaa = T,K,A, or none
  VARIANT 563: Xaa = N,I,V,A,L, or none
  VARIANT 564: Xaa = Q,E,A,R,M,T, or none
  VARIANT 565: Xaa = S,A,D,P, or none
  VARIANT 566: Xaa = V,R, or none
  VARIANT 567: Xaa = V,I,C, or none
  VARIANT 568: Xaa = G, or none
  VARIANT 569: Xaa = A,E, or none
  VARIANT 570: Xaa = E, or none
  VARIANT 571: Xaa = D, or none
  VARIANT 572: Xaa = G, or none
  VARIANT 573: Xaa = R,T,A,G, or none
  VARIANT 574: Xaa = E,R,A,T, or none
  VARIANT 575: Xaa = M,T,R,E,A,V, or none
  VARIANT 576: Xaa = N,S,A,G,D, or none
  VARIANT 577: Xaa = E,M,T,V,G, or none
  VARIANT 578: Xaa = R,G,S,P, or none
  VARIANT 579: Xaa = R,K,G, or none
  VARIANT 580: Xaa = E,A,K, or none
  VARIANT 581: Xaa = K,R,G,A, or none
  VARIANT 582: Xaa = W,L, or none
  VARIANT 583: Xaa = C,A,R, or none
  VARIANT 584: Xaa = E,D,A, or none
  VARIANT 585: Xaa = R, or none
  VARIANT 586: Xaa = M,L, or none
  VARIANT 587: Xaa = K,R,T,S,A, or none
  VARIANT 588: Xaa = E,R,A,N, or none
  VARIANT 589: Xaa = A,K,T,V, or none
  VARIANT 590: Xaa = G, or none
  VARIANT 591: Xaa = F, or none
  VARIANT 592: Xaa = A,V,D,E, or none
  VARIANT 593: Xaa = G,E,Q,S,K, or none
  VARIANT 594: Xaa = E,V,A, or none
  VARIANT 595: Xaa = V,G,A,P, or none
  VARIANT 596: Xaa = F,L, or none
  VARIANT 597: Xaa = G,D, or none
  VARIANT 598: Xaa = E,G,A, or none
  VARIANT 599: Xaa = D,E, or none
  VARIANT 600: Xaa = A,E,V, or none
  VARIANT 601: Xaa = I,V,A, or none
  VARIANT 602: Xaa = D,A,E, or none
  VARIANT 603: Xaa = G,E,S,T, or none
  VARIANT 604: Xaa = G,V,A, or none
  VARIANT 605: Xaa = R,K, or none
  VARIANT 606: Xaa = A,H,S,R, or none
  VARIANT 607: Xaa = L, or none
  VARIANT 608: Xaa = L, or none
  VARIANT 609: Xaa = R,S, or none
  VARIANT 610: Xaa = K,E, or none
  VARIANT 611: Xaa = Y,H, or none
  VARIANT 612: Xaa = D,E,A, or none
  VARIANT 613: Xaa = N,S,G,T, or none
  VARIANT 614: Xaa = N,G, or none
  VARIANT 615: Xaa = W, or none
  VARIANT 616: Xaa = E,G, or none
  VARIANT 617: Xaa = M,V,S,L, or none
  VARIANT 618: Xaa = K,S,P,R,V, or none
  VARIANT 619: Xaa = V,R,T,I,A,L, or none
  VARIANT 620: Xaa = E,A,V,T,R,P,S, or none
  VARIANT 621: Xaa = E,D,A,R,S, or none
  VARIANT 622: Xaa = A,R,P, or none
  VARIANT 623: Xaa = A,R,S, or none
  VARIANT 624: Xaa = T,K,R, or none
  VARIANT 625: Xaa = G,E, or none
  VARIANT 626: Xaa = N,D,G,A,K,T, or none
  VARIANT 627: Xaa = S,N,G,D,A, or none
  VARIANT 628: Xaa = T,R,D,G,E,A, or none
  VARIANT 629: Xaa = S,M,A,C, or none
  VARIANT 630: Xaa = V,L,I, or none
  VARIANT 631: Xaa = E,G,V,A,D, or none
  VARIANT 632: Xaa = L,A, or none
  VARIANT 633: Xaa = W,T,R,P, or none
  VARIANT 634: Xaa = W, or none
  VARIANT 635: Xaa = K,R,E, or none
  VARIANT 636: Xaa = S,G,C, or none
  VARIANT 637: Xaa = G, or none
  VARIANT 638: Xaa = G, or none
  VARIANT 639: Xaa = K, or none
  VARIANT 640: Xaa = G, or none
  VARIANT 641: Xaa = S, or none
  VARIANT 642: Xaa = R, or none
  VARIANT 643: Xaa = Q,H,C,L, or none
  VARIANT 644: Xaa = P,S,A, or none
  VARIANT 645: Xaa = V,A,S,I, or none
  VARIANT 646: Xaa = S,V,A, or none
  VARIANT 647: Xaa = F,R, or none
  VARIANT 648: Xaa = C,T,S, or none
  VARIANT 649: Xaa = S,T,G, or none
  VARIANT 650: Xaa = L,A,R,M, or none
  VARIANT 651: Xaa = W,R, or none
  VARIANT 652: Xaa = K,A,R,W,T, or none
  VARIANT 653: Xaa = L,P,R,S,I, or none
  VARIANT 654: Xaa = D,N,A,S, or none
  VARIANT 655: Xaa = K,G,M,L,A,Q,C, or none
  VARIANT 656: Xaa = Q,N,S,K,A, or none
  VARIANT 657: Xaa = P,D,Y,M,G,S, or none
  VARIANT 658: Xaa = E,Q,K,N,P, or none
  VARIANT 659: Xaa = S,T,G,D,V, or none
  VARIANT 660: Xaa = S,K,L, or none
  VARIANT 661: Xaa = T,I, or none
  VARIANT 662: Xaa = F,G, or none
  VARIANT 663: Xaa = T,P, or none
  VARIANT 664: Xaa = S,C, or none
  VARIANT 665: Xaa = A, or none
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 208 - protein, 785 aa, Artificial Sequence
  Synthetic Construct
  VARIANT 1: Xaa = A, or none
  VARIANT 2: Xaa = G, or none
  VARIANT 3: Xaa = S, or none
  VARIANT 4: Xaa = L, or none
  VARIANT 5: Xaa = A, or none
  VARIANT 6: Xaa = R, or none
  VARIANT 7: Xaa = I, or none
  VARIANT 8: Xaa = Y, or none
  VARIANT 9: Xaa = R, or none
  VARIANT 10: Xaa = A, or none
  VARIANT 11: Xaa = R, or none
  VARIANT 12: Xaa = G, or none
  VARIANT 13: Xaa = D, or none
  VARIANT 14: Xaa = K, or none
  VARIANT 15: Xaa = E, or none
  VARIANT 16: Xaa = G, or none
  VARIANT 17: Xaa = C, or none
  VARIANT 18: Xaa = C, or none
  VARIANT 19: Xaa = W, or none
  VARIANT 20: Xaa = V, or none
  VARIANT 21: Xaa = E, or none
  VARIANT 22: Xaa = W, or none
  VARIANT 23: Xaa = L, or none
  VARIANT 24: Xaa = G, or none
  VARIANT 25: Xaa = A, or none
  VARIANT 26: Xaa = T, or none
  VARIANT 27: Xaa = G, or none
  VARIANT 28: Xaa = F, or none
  VARIANT 29: Xaa = K, or none
  VARIANT 30: Xaa = E, or none
  VARIANT 31: Xaa = V, or none
  VARIANT 32: Xaa = N, or none
  VARIANT 33: Xaa = I, or none
  VARIANT 34: Xaa = S, or none
  VARIANT 35: Xaa = F, or none
  VARIANT 36: Xaa = A, or none
  VARIANT 37: Xaa = S,N, or none
  VARIANT 38: Xaa = L,H, or none
  VARIANT 39: Xaa = C, or none
  VARIANT 40: Xaa = T,Q, or none
  VARIANT 41: Xaa = C,A, or none
  VARIANT 42: Xaa = K, or none
  VARIANT 43: Xaa = I,L, or none
  VARIANT 44: Xaa = C,L, or none
  VARIANT 45: Xaa = L, or none
  VARIANT 46: Xaa = G, or none
  VARIANT 47: Xaa = L, or none
  VARIANT 48: Xaa = F, or none
  VARIANT 49: Xaa = N, or none
  VARIANT 50: Xaa = D, or none
  VARIANT 51: Xaa = G, or none
  VARIANT 52: Xaa = M,Y, or none
  VARIANT 53: Xaa = E,R, or none
  VARIANT 54: Xaa = T,V, or none
  VARIANT 55: Xaa = M,E, or none
  VARIANT 56: Xaa = S,E, or none
  VARIANT 57: Xaa = Y,A,M, or none
  VARIANT 58: Xaa = P,G, or none
  VARIANT 59: Xaa = C, or none
  VARIANT 60: Xaa = S,P,N, or none
  VARIANT 61: Xaa = P,R,L, or none
  VARIANT 62: Xaa = L, or none
  VARIANT 63: Xaa = L,S,V,I, or none
  VARIANT 64: Xaa = S,P,L, or none
  VARIANT 65: Xaa = L,R,G,F, or none
  VARIANT 66: Xaa = P,F,W,S, or none
  VARIANT 67: Xaa = T,P,K, or none
  VARIANT 68: Xaa = H,R,S,Q, or none
  VARIANT 69: Xaa = A,R,F, or none
  VARIANT 70: Xaa = K,R,E, or none
  VARIANT 71: Xaa = T,L,E, or none
  VARIANT 72: Xaa = F,L,I, or none
  VARIANT 73: Xaa = E,Q,S, or none
  VARIANT 74: Xaa = E,R,A,S, or none
  VARIANT 75: Xaa = S,G, or none
  VARIANT 76: Xaa = D,I, or none
  VARIANT 77: Xaa = K,W, or none
  VARIANT 78: Xaa = K,T, or none
  VARIANT 79: Xaa = Q,S, or none
  VARIANT 80: Xaa = H,P, or none
  VARIANT 81: Xaa = S,M, or none
  VARIANT 82: Xaa = V,D,A, or none
  VARIANT 83: Xaa = T,S, or none
  VARIANT 84: Xaa = T,D,L, or none
  VARIANT 85: Xaa = R,L,M, or none
  VARIANT 86: Xaa = E,Q,S, or none
  VARIANT 87: Xaa = G,I,S, or none
  VARIANT 88: Xaa = M,A,I,S,D, or none
  VARIANT 89: Xaa = D,M,P, or none
  VARIANT 90: Xaa = L,D,A,E,I, or none
  VARIANT 91: Xaa = M,V,I,G,P,T, or none
  VARIANT 92: Xaa = D,L,T,A,M, or none
  VARIANT 93: Xaa = I,M,V, or none
  VARIANT 94: Xaa = M,I,E,D, or none
  VARIANT 95: Xaa = D,E,G, or none
  VARIANT 96: Xaa = A,D,I,V,T, or none
  VARIANT 97: Xaa = I,P,D,V,F,L,A, or none
  VARIANT 98: Xaa = N,D,M,H,G,S, or none
  VARIANT 99: Xaa = D,F,N,E, or none
  VARIANT 100: Xaa = L,M,F, or none
  VARIANT 101: Xaa = H,D,E, or none
  VARIANT 102: Xaa = F,I, or none
  VARIANT 103: Xaa = S,D, or none
  VARIANT 104: Xaa = G,D,C,N,R, or none
  VARIANT 105: Xaa = H,Y,C,R, or none
  VARIANT 106: Xaa = S,G,T, or none
  VARIANT 107: Xaa = S,I,T, or none
  VARIANT 108: Xaa = L,T,I, or none
  VARIANT 109: Xaa = T,S,A, or none
  VARIANT 110: Xaa = I,T, or none
  VARIANT 111: Xaa = S,T,N,P, or none
  VARIANT 112: Xaa = A,T,S,P, or none
  VARIANT 113: Xaa = T, or none
  VARIANT 114: Xaa = T, or none
  VARIANT 115: Xaa = I, or none
  VARIANT 116: Xaa = T, or none
  VARIANT 117: Xaa = T, or none
  VARIANT 118: Xaa = T, or none
  VARIANT 119: Xaa = N,S,P,T,D, or none
  VARIANT 120: Xaa = T,P,A, or none
  VARIANT 121: Xaa = T,I,S,A, or none
  VARIANT 122: Xaa = P,L,S, or none
  VARIANT 123: Xaa = T,S,A, or none
  VARIANT 124: Xaa = S,L,E, or none
  VARIANT 125: Xaa = D,H,N,E, or none
  VARIANT 126: Xaa = E,D, or none
  VARIANT 127: Xaa = D,G,H,Q, or none
  VARIANT 128: Xaa = Y,C,M,H,T, or none
  VARIANT 129: Xaa = G,N,A,D, or none
  VARIANT 130: Xaa = M, or none
  VARIANT 131: Xaa = L,C,M, or none
  VARIANT 132: Xaa = C,K,Y,G, or none
  VARIANT 133: Xaa = T,N,G,S,A, or none
  VARIANT 134: Xaa = W,N,F,L, or none
  VARIANT 135: Xaa = N,T, or none
  VARIANT 136: Xaa = N,F,L,G, or none
  VARIANT 137: Xaa = H,L,I,A,D,G,E,M, or none
  VARIANT 138: Xaa = W,L,F, or none
  VARIANT 139: Xaa = S, or none
  VARIANT 140: Xaa = P, or none
  VARIANT 141: Xaa = I,L,V,Q, or none
  VARIANT 142: Xaa = V,I,A,F,T, or none
  VARIANT 143: Xaa = N,D,A,E, or none
  VARIANT 144: Xaa = W,L,E, or none
  VARIANT 145: Xaa = D,E,H,G,N,A, or none
  VARIANT 146: Xaa = T,S,A,E,M,P,N,L, or none
  VARIANT 147: Xaa = F,L,N,H, or none
  VARIANT 148: Xaa = T,N,A,C,S,E, or none
  VARIANT 149: Xaa = T,N, or none
  VARIANT 150: Xaa = I,A, or none
  VARIANT 151: Xaa = N, or none
  VARIANT 152: Xaa = M, or none
  VARIANT 153: Xaa = Y, or none
  VARIANT 154: Xaa = E, or none
  VARIANT 155: Xaa = F, or none
  VARIANT 156: Xaa = H,D, or none
  VARIANT 157: Xaa = V,A, or none
  VARIANT 158: Xaa = G,A,D,S,C,P, or none
  VARIANT 159: Xaa = A,C,H,S,G, or none
  VARIANT 160: Xaa = P,E,H,S,D,G, or none
  VARIANT 161: Xaa = T,D,H, or none
  VARIANT 162: Xaa = D, or none
  VARIANT 163: Xaa = Q,G, or none
  VARIANT 164: Xaa = Q,G,I,A, or none
  VARIANT 165: Xaa = D,N,H,Q, or none
  VARIANT 166: Xaa = D,Q,N, or none
  VARIANT 167: Xaa = F,L,D, or none
  VARIANT 168: Xaa = H,Q,N, or none
  VARIANT 169: Xaa = H,T,Q,V,G,D,N, or none
  VARIANT 170: Xaa = L,I,F, or none
  VARIANT 171: Xaa = M,I,L, or none
  VARIANT 172: Xaa = D,E, or none
  VARIANT 173: Xaa = T,S,M, or none
  VARIANT 174: Xaa = I,V,M, or none
  VARIANT 175: Xaa = I,M,L,V, or none
  VARIANT 176: Xaa = E,I,C,D,Q,H,S,Y, or none
  VARIANT 177: Xaa = D,Q,G,E, or none
  VARIANT 178: Xaa = R,N,S,G,D,E, or none
  VARIANT 179: Xaa = T,N,A,G,S,P, or none
  VARIANT 180: Xaa = T,D,A,L,F,N, or none
  VARIANT 181: Xaa = V,D,A,P,I,S,N,C,L, or none
  VARIANT 182: Xaa = L,V,E,G,Q,F, or none
  VARIANT 183: Xaa = E,T,P,F,V,K,S, or none
  VARIANT 184: Xaa = Q,D,P,I,T,E,A, or none
  VARIANT 185: Xaa = L,N,E,C,G,D,Y, or none
  VARIANT 186: Xaa = L,P,N,D,E, or none
  VARIANT 187: Xaa = S,T,D,H,G, or none
  VARIANT 188: Xaa = E,S,Q, or none
  VARIANT 189: Xaa = H, or none
  VARIANT 190: Xaa = D, or none
  VARIANT 191: Xaa = Q, or none
  VARIANT 192: Xaa = I, or none
  VARIANT 193: Xaa = H, or none
  VARIANT 194: Xaa = Q, or none
  VARIANT 195: Xaa = D, or none
  VARIANT 196: Xaa = H, or none
  VARIANT 197: Xaa = E, or none
  VARIANT 198: Xaa = F, or none
  VARIANT 199: Xaa = L, or none
  VARIANT 200: Xaa = E, or none
  VARIANT 201: Xaa = T, or none
  VARIANT 202: Xaa = A,M, or none
  VARIANT 203: Xaa = A,V,M, or none
  VARIANT 204: Xaa = Q,I,V, or none
  VARIANT 205: Xaa = H,Q,L, or none
  VARIANT 206: Xaa = E, or none
  VARIANT 207: Xaa = Y,S,D, or none
  VARIANT 208: Xaa = A,S, or none
  VARIANT 209: Xaa = N, or none
  VARIANT 210: Xaa = D,E, or none
  VARIANT 211: Xaa = W,F,L, or none
  VARIANT 212: Xaa = Q,D,H, or none
  VARIANT 213: Xaa = Q,G, or none
  VARIANT 214: Xaa = D, or none
  VARIANT 215: Xaa = H, or none
  VARIANT 216: Xaa = S, or none
  VARIANT 217: Xaa = H, or none
  VARIANT 218: Xaa = H,D,A, or none
  VARIANT 219: Xaa = Q,G, or none
  VARIANT 220: Xaa = I,L, or none
  VARIANT 221: Xaa = P,H,L, or none
  VARIANT 222: Xaa = D,Q,H,N, or none
  VARIANT 223: Xaa = P,D,A, or none
  VARIANT 224: Xaa = S,E,D,A,H,T,Q, or none
  VARIANT 225: Xaa = I,E,D,M,Q, or none
  VARIANT 226: Xaa = F, or none
  VARIANT 227: Xaa = F,L,R,P, or none
  VARIANT 228: Xaa = T,E,D, or none
  VARIANT 229: Xaa = D,M, or none
  VARIANT 230: Xaa = T,S,H,G,M,L,V, or none
  VARIANT 231: Xaa = A, or none
  VARIANT 232: Xaa = I, or none
  VARIANT 233: Xaa = Q, or none
  VARIANT 234: Xaa = E, or none
  VARIANT 235: Xaa = S, or none
  VARIANT 236: Xaa = A, or none
  VARIANT 237: Xaa = N, or none
  VARIANT 238: Xaa = D, or none
  VARIANT 239: Xaa = L, or none
  VARIANT 240: Xaa = L, or none
  VARIANT 241: Xaa = Q, or none
  VARIANT 242: Xaa = L, or none
  VARIANT 243: Xaa = Q, or none
  VARIANT 244: Xaa = P,D,Y, or none
  VARIANT 245: Xaa = C,D, or none
  VARIANT 246: Xaa = Y,F,C, or none
  VARIANT 247: Xaa = T,D,A,V,S,G, or none
  VARIANT 248: Xaa = T,Q,A,N,V, or none
  VARIANT 249: Xaa = T,S,Q,G,P,H,A, or none
  VARIANT 250: Xaa = T,A,N,D,S,E, or none
  VARIANT 251: Xaa = T,S,A,D,N,E, or none
  VARIANT 252: Xaa = T,P,S,F,L,D, or none
  VARIANT 253: Xaa = S,D,P, or none
  VARIANT 254: Xaa = A,V,S,T,L, or none
  VARIANT 255: Xaa = T,S,G,D,A,E, or none
  VARIANT 256: Xaa = T,V,I,A, or none
  VARIANT 257: Xaa = T,F,M,S, or none
  VARIANT 258: Xaa = D,E,T,L,M,F,I, or none
  VARIANT 259: Xaa = E,Y,N,V,Q, or none
  VARIANT 260: Xaa = E,D,C,P,F, or none
  VARIANT 261: Xaa = E,D,G, or none
  VARIANT 262: Xaa = E,D, or none
  VARIANT 263: Xaa = E,R, or none
  VARIANT 264: Xaa = M,L, or none
  VARIANT 265: Xaa = E,R,A, or none
  VARIANT 266: Xaa = T,I,V, or none
  VARIANT 267: Xaa = T,L,A,F, or none
  VARIANT 268: Xaa = T,G, or none
  VARIANT 269: Xaa = T,Q,H,S, or none
  VARIANT 270: Xaa = T,E,P, or none
  VARIANT 271: Xaa = T,S,V,N,E, or none
  VARIANT 272: Xaa = T,A,D,Q,F,E,N, or none
  VARIANT 273: Xaa = T,E,D,A,H,S, or none
  VARIANT 274: Xaa = A,E,G,D,V,P, or none
  VARIANT 275: Xaa = I,S,D,N,P,Q,E, or none
  VARIANT 276: Xaa = K,E,L,D,V,S,T,A, or none
  VARIANT 277: Xaa = T,S,E,V,L,D,A,N, or none
  VARIANT 278: Xaa = H,D,T,A,P,E,N,Q, or none
  VARIANT 279: Xaa = E,S,G,I,Q,T,N,P,L,A,K, or none
  VARIANT 280: Xaa = V,T,P,Q,D,N,S,A,G, or none
  VARIANT 281: Xaa = G,V,E,C,S,A,D, or none
  VARIANT 282: Xaa = D,G,E,N,C,H, or none
  VARIANT 283: Xaa = D,L,P,H, or none
  VARIANT 284: Xaa = S,E,M,F,L,I, or none
  VARIANT 285: Xaa = K,R,E,N, or none
  VARIANT 286: Xaa = G,E
  VARIANT 287: Xaa = L,N,E,D
  VARIANT 288: Xaa = K,R,S
  VARIANT 289: Xaa = L,V,A
  VARIANT 290: Xaa = V,L,T,G,S
  VARIANT 291: Xaa = H,D
  VARIANT 294: Xaa = M,L
  VARIANT 295: Xaa = A,T
  VARIANT 296: Xaa = G,A
  VARIANT 298: Xaa = E,M
  VARIANT 300: Xaa = L,V
  VARIANT 301: Xaa = T,S,E,D
  VARIANT 302: Xaa = G,S,A,P
  VARIANT 303: Xaa = S,G,A,P,V,T
  VARIANT 304: Xaa = T,P,D,H,N,A,Q
  VARIANT 305: Xaa = K,E, or none
  VARIANT 306: Xaa = N,S, or none
  VARIANT 307: Xaa = R,H,P,A,S
  VARIANT 308: Xaa = D,R,E,V,I,Y
  VARIANT 309: Xaa = L,F,H
  VARIANT 311: Xaa = R,L,S
  VARIANT 312: Xaa = V,A
  VARIANT 313: Xaa = I,V,A
  VARIANT 314: Xaa = L,F,M
  VARIANT 315: Xaa = I,V,S
  VARIANT 318: Xaa = K,N,D
  VARIANT 319: Xaa = E,G,D,Q
  VARIANT 320: Xaa = L,M,F
  VARIANT 321: Xaa = V,L,A
  VARIANT 322: Xaa = S,L,A
  VARIANT 323: Xaa = Q,P,H,S,G,D
  VARIANT 324: Xaa = H,A,T,I, or none
  VARIANT 325: Xaa = A,P, or none
  VARIANT 326: Xaa = P,A,E,S,G, or none
  VARIANT 327: Xaa = R, or none
  VARIANT 328: Xaa = R, or none
  VARIANT 329: Xaa = G,S,A,D, or none
  VARIANT 330: Xaa = N,C, or none
  VARIANT 331: Xaa = A,T,P,N,E,G,S
  VARIANT 332: Xaa = N,Q,H,A,D,G
  VARIANT 333: Xaa = G,A,T,V
  VARIANT 334: Xaa = S,T,G
  VARIANT 335: Xaa = N,T,S,P
  VARIANT 336: Xaa = M,I,F,V
  VARIANT 337: Xaa = E,D
  VARIANT 338: Xaa = R,H
  VARIANT 341: Xaa = A,Y,T
  VARIANT 342: Xaa = H,Y
  VARIANT 344: Xaa = T,S,A,D,G
  VARIANT 345: Xaa = E,H,D,Q,R,S
  VARIANT 346: Xaa = A,G
  VARIANT 348: Xaa = H,Q,R,K
  VARIANT 349: Xaa = G,S,L,A,N
  VARIANT 350: Xaa = L,R
  VARIANT 351: Xaa = L,I,M
  VARIANT 352: Xaa = E,N,S,D
  VARIANT 353: Xaa = G,S
  VARIANT 354: Xaa = A,T,S
  VARIANT 355: Xaa = G,A,S,H
  VARIANT 356: Xaa = G,S,T,P
  VARIANT 357: Xaa = A,G,S,V,P
  VARIANT 358: Xaa = H,A,C,S,G,T, or none
  VARIANT 359: Xaa = N,T,H,S,G,Y,L
  VARIANT 360: Xaa = N,P,T,G,S,Q,H,I,A, or none
  VARIANT 361: Xaa = H,N,P,S,K,G,A,T, or none
  VARIANT 362: Xaa = H,K,N,R,T, or none
  VARIANT 363: Xaa = H,R,K,Q,L,S, or none
  VARIANT 364: Xaa = H,A,I,M, or none
  VARIANT 365: Xaa = N,H,F, or none
  VARIANT 366: Xaa = N,H, or none
  VARIANT 367: Xaa = N,Y,H, or none
  VARIANT 368: Xaa = K,N,Y, or none
  VARIANT 369: Xaa = H,I, or none
  VARIANT 370: Xaa = Y,I,T, or none
  VARIANT 371: Xaa = L,T,I,Y, or none
  VARIANT 372: Xaa = T,S,N, or none
  VARIANT 373: Xaa = T,S,G,P, or none
  VARIANT 374: Xaa = N,C,P, or none
  VARIANT 375: Xaa = G,Y, or none
  VARIANT 376: Xaa = P,H,S, or none
  VARIANT 377: Xaa = H, or none
  VARIANT 378: Xaa = H,A, or none
  VARIANT 379: Xaa = H,A,M,P, or none
  VARIANT 380: Xaa = R,H,A,Y, or none
  VARIANT 381: Xaa = D,R,A,K, or none
  VARIANT 382: Xaa = D,S, or none
  VARIANT 383: Xaa = H, or none
  VARIANT 384: Xaa = H,G, or none
  VARIANT 385: Xaa = P,H,D,E, or none
  VARIANT 386: Xaa = H,P,E,A,Q, or none
  VARIANT 387: Xaa = D,N,H,P,Q, or none
  VARIANT 388: Xaa = N,P,H,L,S,A
  VARIANT 389: Xaa = Q,P,A,T
  VARIANT 390: Xaa = N,I,S,G,A,E,T
  VARIANT 391: Xaa = D,N,W,G
  VARIANT 392: Xaa = T,R,V,I,S,N
  VARIANT 393: Xaa = L,M,S
  VARIANT 394: Xaa = A,T,S,P,L
  VARIANT 395: Xaa = A,V
  VARIANT 396: Xaa = F,Q,Y,H
  VARIANT 397: Xaa = Q,R,H
  VARIANT 398: Xaa = L,I,M
  VARIANT 399: Xaa = L,I
  VARIANT 401: Xaa = D,E
  VARIANT 402: Xaa = M,L
  VARIANT 403: Xaa = S,T
  VARIANT 405: Xaa = Y,F
  VARIANT 406: Xaa = V,I,A,M,L
  VARIANT 409: Xaa = G,A
  VARIANT 413: Xaa = A,T
  VARIANT 418: Xaa = I,L,F
  VARIANT 419: Xaa = E,D
  VARIANT 420: Xaa = A,S,T
  VARIANT 421: Xaa = V,T,I
  VARIANT 422: Xaa = A,K,I,S,T,V
  VARIANT 423: Xaa = H,G,Q,D
  VARIANT 424: Xaa = E,D
  VARIANT 425: Xaa = R,K,A,L,M
  VARIANT 426: Xaa = R,H,D
  VARIANT 427: Xaa = V,I
  VARIANT 429: Xaa = V,I
  VARIANT 430: Xaa = I,V
  VARIANT 432: Xaa = Y,L,F
  VARIANT 433: Xaa = D,N
  VARIANT 434: Xaa = I,L,V
  VARIANT 435: Xaa = M,T,G,A
  VARIANT 438: Xaa = V,A,I
  VARIANT 441: Xaa = A,P,S
  VARIANT 444: Xaa = I,M
  VARIANT 445: Xaa = Q,S,L
  VARIANT 446: Xaa = S,A,D,K
  VARIANT 447: Xaa = L,M
  VARIANT 448: Xaa = A,S,T,V,L
  VARIANT 449: Xaa = S,R,L
  VARIANT 450: Xaa = N,H,R,C,D, or none
  VARIANT 451: Xaa = N,K,G,P,T,A,S, or none
  VARIANT 452: Xaa = N,A,T,D, or none
  VARIANT 453: Xaa = G, or none
  VARIANT 454: Xaa = P,V, or none
  VARIANT 455: Xaa = P,S,T, or none
  VARIANT 456: Xaa = G,P,T,A, or none
  VARIANT 457: Xaa = P,I,K, or none
  VARIANT 458: Xaa = H,S, or none
  VARIANT 459: Xaa = L,F, or none
  VARIANT 460: Xaa = R,H, or none
  VARIANT 461: Xaa = I,L, or none
  VARIANT 462: Xaa = T, or none
  VARIANT 463: Xaa = A, or none
  VARIANT 464: Xaa = L,V,I, or none
  VARIANT 465: Xaa = S,T, or none
  VARIANT 466: Xaa = R,A,T, or none
  VARIANT 467: Xaa = T,G,D,S,Y, or none
  VARIANT 468: Xaa = G,A,S, or none
  VARIANT 469: Xaa = G,D,A, or none
  VARIANT 470: Xaa = G,Y,C, or none
  VARIANT 471: Xaa = G,S,H, or none
  VARIANT 472: Xaa = G,A, or none
  VARIANT 473: Xaa = N, or none
  VARIANT 474: Xaa = S, or none
  VARIANT 475: Xaa = S, or none
  VARIANT 476: Xaa = S, or none
  VARIANT 477: Xaa = A, or none
  VARIANT 478: Xaa = T,S, or none
  VARIANT 479: Xaa = G, or none
  VARIANT 480: Xaa = R,Q,K, or none
  VARIANT 481: Xaa = R,K, or none
  VARIANT 482: Xaa = S, or none
  VARIANT 483: Xaa = I,T,D,A,F, or none
  VARIANT 484: Xaa = A,R,G,S,T, or none
  VARIANT 485: Xaa = T,S,V,A, or none
  VARIANT 486: Xaa = V,H, or none
  VARIANT 487: Xaa = Q,H,D, or none
  VARIANT 488: Xaa = E,A,T, or none
  VARIANT 489: Xaa = T,S,A,V, or none
  VARIANT 490: Xaa = G,A,V, or none
  VARIANT 491: Xaa = R, or none
  VARIANT 492: Xaa = R,W,L, or none
  VARIANT 493: Xaa = L, or none
  VARIANT 494: Xaa = T,A,S,V, or none
  VARIANT 495: Xaa = S,A,E, or none
  VARIANT 496: Xaa = F, or none
  VARIANT 497: Xaa = A, or none
  VARIANT 498: Xaa = A,E,G,D,T, or none
  VARIANT 499: Xaa = S, or none
  VARIANT 500: Xaa = L,V,I, or none
  VARIANT 501: Xaa = G,N,E, or none
  VARIANT 502: Xaa = Q,L, or none
  VARIANT 503: Xaa = P, or none
  VARIANT 504: Xaa = F, or none
  VARIANT 505: Xaa = S,Q,T, or none
  VARIANT 506: Xaa = F,Y, or none
  VARIANT 507: Xaa = H,S,G,N, or none
  VARIANT 508: Xaa = H,S,Q, or none
  VARIANT 509: Xaa = C,S,L,I, or none
  VARIANT 510: Xaa = R,C, or none
  VARIANT 511: Xaa = L,V, or none
  VARIANT 512: Xaa = D,E,H, or none
  VARIANT 513: Xaa = S,P,N,H, or none
  VARIANT 514: Xaa = D,E,G, or none
  VARIANT 515: Xaa = E,D, or none
  VARIANT 516: Xaa = T,D,R,N,E,I, or none
  VARIANT 517: Xaa = F,L, or none
  VARIANT 518: Xaa = R,K,H, or none
  VARIANT 519: Xaa = P,E,A, or none
  VARIANT 520: Xaa = S,F,A,N,T, or none
  VARIANT 521: Xaa = A,N,S,T,F, or none
  VARIANT 522: Xaa = L,V, or none
  VARIANT 523: Xaa = K,R,E, or none
  VARIANT 524: Xaa = L,N,M,D, or none
  VARIANT 525: Xaa = V,S,C,I, or none
  VARIANT 526: Xaa = R,K, or none
  VARIANT 527: Xaa = G, or none
  VARIANT 528: Xaa = E,S, or none
  VARIANT 529: Xaa = A,T, or none
  VARIANT 530: Xaa = L,V, or none
  VARIANT 531: Xaa = V,I, or none
  VARIANT 532: Xaa = F,A,I,V,L, or none
  VARIANT 533: Xaa = N,S, or none
  VARIANT 534: Xaa = C, or none
  VARIANT 535: Xaa = M,D,I,V, or none
  VARIANT 536: Xaa = L,T, or none
  VARIANT 537: Xaa = N,H,T,Q, or none
  VARIANT 538: Xaa = L,Q, or none
  VARIANT 539: Xaa = P,A, or none
  VARIANT 540: Xaa = H,A, or none
  VARIANT 541: Xaa = L,A,F, or none
  VARIANT 542: Xaa = T, or none
  VARIANT 543: Xaa = S,T, or none
  VARIANT 544: Xaa = M,T, or none
  VARIANT 545: Xaa = S,N,P,V,Y,I, or none
  VARIANT 546: Xaa = Y,F,R, or none
  VARIANT 547: Xaa = R,K, or none
  VARIANT 548: Xaa = A,L,P,S,T, or none
  VARIANT 549: Xaa = P,S,L,T, or none
  VARIANT 550: Xaa = E,G,D,S, or none
  VARIANT 551: Xaa = S,K,T, or none
  VARIANT 552: Xaa = V,L,I, or none
  VARIANT 553: Xaa = A,G,P,T,Q, or none
  VARIANT 554: Xaa = S,A, or none
  VARIANT 555: Xaa = L, or none
  VARIANT 556: Xaa = F,L, or none
  VARIANT 557: Xaa = L,P
  VARIANT 558: Xaa = N,R,S,A,T,G,V,K
  VARIANT 559: Xaa = G,C,T
  VARIANT 560: Xaa = A,V,M,S,I
  VARIANT 561: Xaa = K,E,A,T
  VARIANT 562: Xaa = T,E,A,L,S,I,K
  VARIANT 564: Xaa = N,K,Q,G
  VARIANT 565: Xaa = P,S,A
  VARIANT 566: Xaa = K,R
  VARIANT 567: Xaa = L,V
  VARIANT 568: Xaa = V,M,L
  VARIANT 569: Xaa = T,V,I
  VARIANT 570: Xaa = L,I,V,T
  VARIANT 571: Xaa = V,I
  VARIANT 573: Xaa = E,D
  VARIANT 574: Xaa = E,D
  VARIANT 575: Xaa = V,M,L,G,Q
  VARIANT 576: Xaa = G,A,V,E,S,R
  VARIANT 577: Xaa = S,C,R,A,P,H, or none
  VARIANT 578: Xaa = V,S,I,E,R,A
  VARIANT 579: Xaa = G,K,S, or none
  VARIANT 580: Xaa = K,N,R,D, or none
  VARIANT 581: Xaa = E,N,G,D, or none
  VARIANT 582: Xaa = V,E,P,D, or none
  VARIANT 583: Xaa = S,P,G, or none
  VARIANT 584: Xaa = D, or none
  VARIANT 585: Xaa = L,E,S,P, or none
  VARIANT 586: Xaa = A,P,K, or none
  VARIANT 587: Xaa = S,G,D, or none
  VARIANT 588: Xaa = D,L, or none
  VARIANT 589: Xaa = I,A,V,G,E, or none
  VARIANT 590: Xaa = A,C,D,S,G, or none
  VARIANT 591: Xaa = D,K,A,P,S,E, or none
  VARIANT 592: Xaa = G,S,A,P,E
  VARIANT 593: Xaa = G,S,P
  VARIANT 595: Xaa = V,P,M
  VARIANT 596: Xaa = E,G,A,D,S,R
  VARIANT 597: Xaa = R,F,Q,L
  VARIANT 599: Xaa = M,F,I,S
  VARIANT 600: Xaa = D,E,N
  VARIANT 601: Xaa = S,A,E,T
  VARIANT 602: Xaa = L,V
  VARIANT 603: Xaa = H,A,Q
  VARIANT 604: Xaa = H,R
  VARIANT 605: Xaa = Y,F
  VARIANT 606: Xaa = S,T
  VARIANT 607: Xaa = A,T
  VARIANT 608: Xaa = V,L
  VARIANT 609: Xaa = F,W,Y,M
  VARIANT 610: Xaa = D,E
  VARIANT 612: Xaa = L,T,M
  VARIANT 613: Xaa = E,A
  VARIANT 614: Xaa = A,V,S
  VARIANT 615: Xaa = G,C,S
  VARIANT 616: Xaa = F,L
  VARIANT 617: Xaa = P,A,V,I
  VARIANT 618: Xaa = M,G,T,S,L
  VARIANT 619: Xaa = Q,G,Y,S
  VARIANT 620: Xaa = N,T,G,S,D,K
  VARIANT 621: Xaa = R,W,Q,D,Y
  VARIANT 622: Xaa = G,E, or none
  VARIANT 623: Xaa = V,A,P, or none
  VARIANT 624: Xaa = W, or none
  VARIANT 625: Xaa = L, or none
  VARIANT 626: Xaa = A,C,V,S
  VARIANT 627: Xaa = R,L
  VARIANT 628: Xaa = T,A,R,G
  VARIANT 629: Xaa = L,R
  VARIANT 631: Xaa = E,G
  VARIANT 632: Xaa = R,K,E,M
  VARIANT 633: Xaa = V,E,A
  VARIANT 634: Xaa = F,M,I,V,L
  VARIANT 635: Xaa = F,L,V
  VARIANT 636: Xaa = G,A
  VARIANT 638: Xaa = R,N,Q
  VARIANT 639: Xaa = I,V
  VARIANT 640: Xaa = A,T,V,Q,E
  VARIANT 641: Xaa = G,D,N
  VARIANT 642: Xaa = S,F,A,T
  VARIANT 643: Xaa = L,V,I
  VARIANT 644: Xaa = G,A,S,V
  VARIANT 645: Xaa = R,Q,K,L
  VARIANT 646: Xaa = I,M,L,Y,A,V
  VARIANT 647: Xaa = Y,G
  VARIANT 648: Xaa = R,G,S, or none
  VARIANT 649: Xaa = T,S,V,G,A,L, or none
  VARIANT 650: Xaa = G,E,T,A,R,V
  VARIANT 651: Xaa = D, or none
  VARIANT 652: Xaa = G,T,E,A,V
  VARIANT 653: Xaa = E,D,N,G, or none
  VARIANT 654: Xaa = V,A,G, or none
  VARIANT 655: Xaa = E,K, or none
  VARIANT 656: Xaa = E,G,D,A, or none
  VARIANT 657: Xaa = R,K,G, or none
  VARIANT 658: Xaa = R,V,G,C,S,A, or none
  VARIANT 659: Xaa = S,G,C, or none
  VARIANT 660: Xaa = W, or none
  VARIANT 661: Xaa = G,N,V,E, or none
  VARIANT 662: Xaa = E,A,Q, or none
  VARIANT 663: Xaa = W,P,R,A,S
  VARIANT 664: Xaa = L,V,M,Q,E
  VARIANT 665: Xaa = G,V,R,M,S
  VARIANT 666: Xaa = E,A,L,G,M
  VARIANT 667: Xaa = V,A,E,S,T,N
  VARIANT 668: Xaa = G,R
  VARIANT 669: Xaa = F,Y,L
  VARIANT 670: Xaa = R,G,E,K,M,T,C
  VARIANT 671: Xaa = G,A,M,E
  VARIANT 672: Xaa = V,C,A,R,S
  VARIANT 673: Xaa = P,D,N,E
  VARIANT 674: Xaa = V,L,M,I
  VARIANT 676: Xaa = F,G,C,A
  VARIANT 677: Xaa = A,C,F
  VARIANT 678: Xaa = N,S
  VARIANT 679: Xaa = H,V,I
  VARIANT 680: Xaa = C,A,S
  VARIANT 682: Xaa = A,G
  VARIANT 683: Xaa = K,N,R
  VARIANT 684: Xaa = L,M
  VARIANT 686: Xaa = L,I,V,A
  VARIANT 690: Xaa = N,G
  VARIANT 691: Xaa = D,R,G
  VARIANT 692: Xaa = G,V
  VARIANT 693: Xaa = Y,F
  VARIANT 694: Xaa = R,E,T,G
  VARIANT 695: Xaa = V,I,M
  VARIANT 696: Xaa = E,V
  VARIANT 697: Xaa = E,H,K,F
  VARIANT 698: Xaa = V,L,T,M,Q,I, or none
  VARIANT 699: Xaa = G, or none
  VARIANT 700: Xaa = V, or none
  VARIANT 701: Xaa = G,E,R,D,K,S
  VARIANT 702: Xaa = S,N,T,K,P,C,G,A
  VARIANT 703: Xaa = N,G,I
  VARIANT 704: Xaa = K,R,S
  VARIANT 705: Xaa = L,I
  VARIANT 706: Xaa = V,M,A,L
  VARIANT 707: Xaa = L,M
  VARIANT 708: Xaa = D,G,C,V
  VARIANT 709: Xaa = W,Y
  VARIANT 710: Xaa = K,Y
  VARIANT 711: Xaa = S,A,I
  VARIANT 712: Xaa = R,S
  VARIANT 713: Xaa = R,P,L
  VARIANT 714: Xaa = G, or none
  VARIANT 715: Xaa = K, or none
  VARIANT 716: Xaa = N, or none
  VARIANT 717: Xaa = D, or none
  VARIANT 718: Xaa = L, or none
  VARIANT 719: Xaa = R, or none
  VARIANT 720: Xaa = L,E
  VARIANT 721: Xaa = L,T,I,P,M
  VARIANT 722: Xaa = S,N
  VARIANT 723: Xaa = A,V,K
  VARIANT 724: Xaa = S,V
  VARIANT 725: Xaa = L,V,I
  VARIANT 727: Xaa = T,S,A,C
  VARIANT 728: Xaa = C,S,Q,P,T
  VARIANT 729: Xaa = S,N,I,P,K,L,M
  VARIANT 730: Xaa = S,N,L,P,F,A,D, or none
  VARIANT 731: Xaa = S,H,K,L,D,A,V, or none
  VARIANT 732: Xaa = D,F,S,E,G,P,I, or none
  VARIANT 733: Xaa = S,D,R,V,C, or none
  VARIANT 734: Xaa = D,S,P,L,G, or none
  VARIANT 735: Xaa = L,S,Q,H, or none
  VARIANT 736: Xaa = S,I,H, or none
  VARIANT 737: Xaa = P,I,G, or none
  VARIANT 738: Xaa = A,I,P,T, or none
  VARIANT 739: Xaa = E,V,D, or none
  VARIANT 740: Xaa = G,V, or none
  VARIANT 741: Xaa = L, or none
  VARIANT 742: Xaa = A, or none
  VARIANT 743: Xaa = F, or none
  VARIANT 744: Xaa = Y, or none
  VARIANT 745: Xaa = V,A, or none
  VARIANT 746: Xaa = C,A,F, or none
  VARIANT 747: Xaa = Q,D, or none
  VARIANT 748: Xaa = P,K, or none
  VARIANT 749: Xaa = M,L,V, or none
  VARIANT 750: Xaa = L,V, or none
  VARIANT 751: Xaa = G,E, or none
  VARIANT 752: Xaa = M,F, or none
  VARIANT 753: Xaa = A,K,S, or none
  VARIANT 754: Xaa = P, or none
  VARIANT 755: Xaa = K,V, or none
  VARIANT 756: Xaa = G, or none
  VARIANT 757: Xaa = I, or none
  VARIANT 758: Xaa = E, or none
  VARIANT 759: Xaa = T, or none
  VARIANT 760: Xaa = Y, or none
  VARIANT 761: Xaa = A,I,S,D, or none
  VARIANT 762: Xaa = S,H,T, or none
  VARIANT 763: Xaa = G,P, or none
  VARIANT 764: Xaa = G,A, or none
  VARIANT 765: Xaa = F,V, or none
  VARIANT 766: Xaa = G,E,A, or none
  VARIANT 767: Xaa = R, or none
  VARIANT 768: Xaa = T,A,V, or none
  VARIANT 769: Xaa = E,H,D, or none
  VARIANT 770: Xaa = Y,F, or none
  VARIANT 771: Xaa = D,H, or none
  VARIANT 772: Xaa = Y,K, or none
  VARIANT 773: Xaa = V,E,I, or none
  VARIANT 774: Xaa = D, or none
  VARIANT 775: Xaa = S,R, or none
  VARIANT 776: Xaa = F,M, or none
  VARIANT 777: Xaa = L,W,F, or none
  VARIANT 778: Xaa = V,Q, or none
  VARIANT 779: Xaa = E, or none
  VARIANT 780: Xaa = P,Y, or none
  VARIANT 781: Xaa = A,E, or none
  VARIANT 782: Xaa = Y,N, or none
  VARIANT 783: Xaa = A, or none
  VARIANT 784: Xaa = L, or none
  VARIANT 785: Xaa = V, or none
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLXXXAXAXXXXXXXXXXAXXXXXRLXXXXXXXXXXXXXXXXXXXXXLAXXFXXXLXXXXXXXXXXXXXXXXXXXXXXXXXXXXXXXXXXXXXXXXXXXXXXXXXXXXQXXXPXXKFXHFTXNQAIXXXXXXXXXXHXXDXXXXEGXQWXSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXEXXXXXXXXXXXXXXXXXXXXXFXXXFXXXXXXXXXXXXSXXXXXXXXXXXXXXXXXXVXXXXXXPXXXXXXXXXXXXXXXXXXXXXXXXXXXXXXXXXXXXXSXXXXXQXXXLXGLFXXXXXXXXXXXXXXXXXXXXXXXXXXXXXXXXXXXXWXXXXXXXXXXXXXXXXXXXXXXXXXXXXXXXXXXXXXXXXXXXXXXXXXXXXXXXXXXX

SEQ ID NO: 209 - protein, 96 aa, Hordeum vulgare
MAGSKHVSSCTCCILIILVVSSHLATCPCEARRLMAASAKIDGDEACMSAGCHAVQGTASGYAGATWVATTDSRGTAPGHSPGIGNKLHAAGNDRR

SEQ ID NO: 210 - protein, 96 aa, Oryza sativa
MAGLKLSSCVLVALLFVSSHVVRHGEARRLTAGVAAPASKGGEEEAPQYASARGGQPAAAAGGGVTAASKMASTDGRPTSPGHSPGIGNKATGNVR

SEQ ID NO: 211 - protein, 106 aa, Oryza sativa
MAGHKVVFCTCILIFIVVVISGQAEARRLAAVANGNEDAVAVEGDGSFRAVQETASSASTDHAAAGRGGGGAATAVQGSMPMTTTDSRPTAPGNSPGIGNKGKINN

SEQ ID NO: 212 - protein, 102 aa, Zea mays
MAASSKVVCACILIVLVISSHADARRLVAATCNGTEGGACKGGIFVQGYAGLSARQKMAATATSTEQVVGGGGEGMPATTTDSRPTAPGNSPGIGNKGKINN

SEQ ID NO: 213 - protein, 92 aa, Manihot esculenta
MATIRAMCTCSLILVLILSHEVLVVEGRRLKSHGNKLCKKCSARTDHRILHVAERSQKLLGSENKTSKMDYVDDFRPTVPGHSPGVGHSLKN

SEQ ID NO: 214 - protein, 124 aa, Artificial Sequence
  Consensus Sequence
  VARIANT 3, 11, 30, 51, 52, 74, 82, 96, 98, 100, 103, 105: Xaa = Gly, Ala, Val, Ser, Thr, Cys
  VARIANT 4, 7, 8, 9, 10, 13, 15, 16, 25, 26, 27, 28, 29, 38, 39, 40, 41,42, 43, 44, 45, 46, 47, 48, 49, 50, 54, 58, 59, 60, 61, 62, 63, 64, 65,66, 67, 70, 76, 78, 85, 86, 87, 88, 89, 90, 91, 92, 93, 94, 97, 101,116, 117, 120, 121, 122, 123, 124: Xaa = Any Amino Acid
  VARIANT 5, 24, 75, 108, 114, 115: Xaa = Ser, Thr, Tyr, His, Arg, Lys, Asp, Asn, Glu, Gln
  VARIANT 6, 17, 20, 36, 53, 55, 68, 77, 84, 95, 118: Xaa = Ala, Ile, Val, Leu, Trp, Phe, Met, Cys, Pro
  VARIANT 14, 18, 19, 21, 112: Xaa = Ile, Val, Leu
  VARIANT 23, 56, 57, 69, 72, 73, 80, 81, 83, 119: Xaa = His, Ser, Gly, Thr, Ala, Arg, Lys, Glu, Gln, Asp, Asn
  VARIANT 31: Xaa = Asp or Glu
  VARIANT 32, 37, 71, 79: Xaa = Ala, Val, Leu, Ala, Trp, Phe, Gly, Met, Cys, Ser, Thr, Tyr, Asn, Gln
MAXXXXXXXXXCXXXXXXXXXSXXXXXXXXXXRRLXXXXXXXXXXXXXXXXXXXXXXXXXXXXXXXXXXXXXXXXXXXXXXXXXXXXXXXXXXXXXXXDXXRXTXPGXSPGXGXXXXXXXXXXX

SEQ ID NO: 215 - protein, 124 aa, Artificial Sequence; identical to SEQ ID NO: 214
  Consensus Sequence
  VARIANT 3, 11, 30, 51, 52, 74, 82, 96, 98, 100, 103, 105: Xaa = Gly, Ala, Val, Ser, Thr, Cys
  VARIANT 4, 7, 8, 9, 10, 13, 15, 16, 25, 26, 27, 28, 29, 38, 39, 40, 41,42, 43, 44, 45, 46, 47, 48, 49, 50, 54, 58, 59, 60, 61, 62, 63, 64, 65,66, 67, 70, 76, 78, 85, 86, 87, 88, 89, 90, 91, 92, 93, 94, 97, 101,116, 117, 120, 121, 122, 123, 124: Xaa = Any Amino Acid
  VARIANT 5, 24, 75, 108, 114, 115: Xaa = Ser, Thr, Tyr, His, Arg, Lys, Asp, Asn, Glu, Gln
  VARIANT 6, 17, 20, 36, 53, 55, 68, 77, 84, 95, 118: Xaa = Ala, Ile, Val, Leu, Trp, Phe, Met, Cys, Pro
  VARIANT 14, 18, 19, 21, 112: Xaa = Ile, Val, Leu
  VARIANT 23, 56, 57, 69, 72, 73, 80, 81, 83, 119: Xaa = His, Ser, Gly, Thr, Ala, Arg, Lys, Glu, Gln, Asp, Asn
  VARIANT 31: Xaa = Asp or Glu
  VARIANT 32, 37, 71, 79: Xaa = Ala, Val, Leu, Ala, Trp, Phe, Gly, Met, Cys, Ser, Tyr, Asn, Gln

SEQ ID NO: 216 - protein, 124 aa, Artificial Sequence
  Consensus Sequence
  VARIANT 3, 23, 52, 81, 82, 100, 105, 118: Xaa = Ala, Val, Leu, Ala, Trp, Phe, Gly, Met, Cys, Ser, Thr, Tyr, Asn, Gln
  VARIANT 4, 8, 9, 16, 25, 26, 27, 28, 29, 38, 39, 40, 41, 45, 46, 47, 48,49, 50, 59, 60, 61, 62, 63, 64, 65, 66, 67, 85, 86, 87, 88, 89, 90, 91,92, 93, 94, 101, 116, 117, 123, 124: Xaa = Any Amino Acid
  VARIANT 5: Xaa = His, Arg, Lys
  VARIANT 6, 13, 36, 55, 68, 78, 95, 120: Xaa = Ala, Ile, Val, Leu, Trp, Phe, Met, Cys, Pro
  VARIANT 7, 30, 43, 51, 53, 69, 70, 73, 74, 77, 80, 84, 96, 122: Xaa = Gly, Ala, Val, Ser, Thr, Cys
  VARIANT 11, 97: Xaa = Ser or Thr
  VARIANT 15, 17, 18, 20, 21: Xaa = Ile, Val, Leu
  VARIANT 24, 58: Xaa = His, Arg, Lys, Asp, Glu
  VARIANT 56, 72, 75, 108, 119: Xaa = Ser, Thr, Tyr, His, Arg, Lys, Asp, Asn, Glu, Gln
  VARIANT 44, 54, 76, 83: Xaa = His, Ser, Gly, Thr, Ala, Arg, Lys, Glu, Gln, Asp, Asn
MAXXXXXXXCXCXLXXXXLXXSXXXXXXXXEARRLXAXXXXGXXXXXXXXXXXXXXGXXXXXXXXXXXXXAXXXXXXXGXXXXXXXXXXXXXXXXXXTDXXRPTXPGXSPGIGNKXXXXXNXXX

SEQ ID NO: 217 - protein, 124 aa, Artificial Sequence; identical to SEQ ID NO: 216
  Consensus Sequence
  VARIANT 3, 23, 52, 81, 82, 100, 105, 118: Xaa = Ala, Val, Leu, Ala, Trp, Phe, Gly, Met, Cys, Ser, Thr, Tyr, Asn, Gln
  VARIANT 4, 8, 9, 16, 25, 26, 27, 28, 29, 38, 39, 40, 41, 45, 46, 47, 48,49, 50, 59, 60, 61, 62, 63, 64, 65, 66, 67, 85, 86, 87, 88, 89, 90, 91,92, 93, 94, 101, 116, 117, 123, 124: Xaa = Any Amino Acid
  VARIANT 5: Xaa = His, Arg, Lys
  VARIANT 6, 13, 36, 55, 68, 78, 95, 120: Xaa = Ala, Ile, Val, Leu, Trp, Phe, Met, Cys, Pro
  VARIANT 7, 30, 43, 51, 53, 69, 70, 73, 74, 77, 80, 84, 96, 122: Xaa = Gly, Ala, Val, Ser, Thr, Cys
  VARIANT 11, 97: Xaa = Ser or Thr
  VARIANT 15, 17, 18, 20, 21: Xaa = Ile, Val, Leu
  VARIANT 24, 58: Xaa = His, Arg, Lys, Asp, Glu
  VARIANT 44, 54, 76, 83: Xaa = His, Ser, Gly, Thr, Ala, Arg, Lys, Glu, Gln, Asp, Asn
  VARIANT 56, 72, 75, 108, 119: Xaa = Ser, Thr, Tyr, His, Arg, Lys, Asp, Asn, Glu, Gln

SEQ ID NO: 218 - protein, 93 aa, Hordeum vulgare
MAGSKHASSCTCILIILLVSSHLAPCEARRLMAASAKINGDAACESSACRAAQGAASGAASTSEMASTDGRGTGQGHSPGIGNKLHASGNGRR

SEQ ID NO: 219 - protein, 96 aa, Oryza sativa; identical to SEQ ID NO: 210

SEQ ID NO: 220 - protein, 102 aa, Zea mays
MAASSKVVCACILIVLVISSHADARRLVAATCNGTEGGACKGGIFVQGYAGLSAPQKMAATATSTEQVVGGGGEGMPATTTDSRPTAPGNSPGIGNKGKINN

SEQ ID NO: 221 - protein, 116 aa, Artificial Sequence
  Consensus Sequence
  VARIANT 3, 36, 60, 61, 64, 70, 93, 97, 110: Xaa = Ala, Val, Leu, Ala, Trp, Phe, Gly, Met, Cys, Ser, Thr, Tyr, Asn, Gln
  VARIANT 4, 9, 10, 11, 19, 24, 25, 26, 27, 39, 40, 41, 42, 52, 53, 54, 55,56, 57, 58, 59, 67, 71, 72, 73, 74, 75, 76, 77, 78, 79, 80, 86, 87, 98,108, 109, 115, 116: Xaa = Any Amino Acid
  VARIANT 5, 43, 51, 63, 100, 111: Xaa = Ser, Thr, Tyr, His, Arg, Lys, Asp, Asn, Glu, Gln
  VARIANT 6, 16, 34, 44, 62, 68, 88, 112: Xaa = Ala, Ile, Val, Leu, Trp, Phe, Met, Cys, Pro
  VARIANT 7, 8, 28, 37, 38, 45, 50, 82, 83, 85, 89, 95, 114: Xaa = Gly, Ala, Val, Ser, Thr, Cys
  VARIANT 13, 15, 18, 20: Xaa = Ile, Val, Leu
  VARIANT 29: Xaa = Asp or Glu
  VARIANT 46, 47, 48, 65, 84: Xaa = His, Ser, Gly, Thr, Ala, Arg, Lys, Glu, Gln, Asp, Asn
  VARIANT 90: Xaa = Ser or Thr
MAXXXXXXXXXCXLXXLXXXSSHXXXXXXARRLXAXXXXXXXXXXXXXAXXXXXXXXXXXXXXXXQXXAXXXXXXXXXXXGXXXXXXXXXTDXRXTXXGXSPGIGNKXXXXXNXXX

SEQ ID NO: 222 - protein, 116 aa, Artificial Sequence; identical to SEQ ID NO: 221
  Consensus Sequence
  VARIANT 3, 36, 60, 61, 64, 70, 93, 97, 110: Xaa = Ala, Val, Leu, Ala, Trp, Phe, Gly, Met, Cys, Ser, Thr, Tyr, Asn, Gln
  VARIANT 4, 9, 10, 11, 19, 24, 25, 26, 27, 39, 40, 41, 42, 52, 53, 54, 55,56, 57, 58, 59, 67, 71, 72, 73, 74, 75, 76, 77, 78, 79, 80, 86, 87, 98,108, 109, 115, 116: Xaa = Any Amino Acid
  VARIANT 5, 43, 51, 63, 100, 111: Xaa = Ser, Thr, Tyr, His, Arg, Lys, Asp, Asn, Glu, Gln
  VARIANT 6, 16, 34, 44, 62, 68, 88, 112: Xaa = Ala, Ile, Val, Leu, Trp, Phe, Met, Cys, Pro
  VARIANT 7, 8, 28, 37, 38, 45, 50, 82, 83, 85, 89, 95, 114: Xaa = Gly, Ala, Val, Ser, Thr, Cys
  VARIANT 13, 15, 18, 20: Xaa = Ile, Val, Leu
  VARIANT 29: Xaa = Asp or Glu
  VARIANT 46, 47, 48, 65, 84: Xaa = His, Ser, Gly, Thr, Ala, Arg, Lys, Glu, Gln, Asp, Asn
  VARIANT 90: Xaa = Ser or Thr

SEQ ID NO: 223 - protein, 116 aa, Artificial Sequence; identical to SEQ ID NO: 221
  Consensus Sequence
  VARIANT 3, 36, 60, 61, 64, 70, 93, 97, 110: Xaa = Ala, Val, Leu, Ala, Trp, Phe, Gly, Met, Cys, Ser, Thr, Tyr, Asn, Gln
  VARIANT 4, 9, 10, 11, 19, 24, 25, 26, 27, 39, 40, 41, 42, 52, 53, 54, 55,56, 57, 58, 59, 67, 71, 72, 73, 74, 75, 76, 77, 78, 79, 80, 86, 87, 98,108, 109, 115, 116: Xaa = Any Amino Acid
  VARIANT 5, 43, 51, 63, 100, 111: Xaa = Ser, Thr, Tyr, His, Arg, Lys, Asp, Asn, Glu, Gln
  VARIANT 6, 16, 34, 44, 62, 68, 88, 112: Xaa = Ala, Ile, Val, Leu, Trp, Phe, Met, Cys, Pro
  VARIANT 7, 8, 28, 37, 38, 45, 50, 82, 83, 85, 89, 95, 114: Xaa = Gly, Ala, Val, Ser, Thr, Cys
  VARIANT 13, 15, 18, 20: Xaa = Ile, Val, Leu
  VARIANT 29: Xaa = Asp or Glu
  VARIANT 46, 47, 48, 65, 84: Xaa = His, Ser, Gly, Thr, Ala, Arg, Lys, Glu, Gln, Asp, Asn
  VARIANT 90: Xaa = Ser or Thr

SEQ ID NO: 224 - protein, 116 aa, Artificial Sequence; identical to SEQ ID NO: 221
  Consensus Sequence
  VARIANT 3, 36, 60, 61, 64, 70, 97, 110: Xaa = Ala, Val, Leu, Ala, Trp, Phe, Gly, Met, Cys, Ser, Thr, Tyr, Asn, Gln
  VARIANT 4, 9, 10, 11, 19, 24, 25, 26, 27, 39, 40, 41, 42, 52, 53, 54, 55,56, 57, 58, 59, 67, 71, 72, 73, 74, 75, 76, 77, 78, 79, 80, 86, 87, 93,98, 108, 109, 115, 116: Xaa = Any Amino Acid
  VARIANT 5, 43, 51, 63, 100, 111: Xaa = Ser, Thr, Tyr, His, Arg, Lys, Asp, Asn, Glu, Gln
  VARIANT 6, 16, 34, 44, 62, 68, 88, 112: Xaa = Ala, Ile, Val, Leu, Trp, Phe, Met, Cys, Pro
  VARIANT 7, 8, 28, 37, 38, 45, 50, 82, 83, 85, 89, 95, 114: Xaa = Gly, Ala, Val, Ser, Thr, Cys
  VARIANT 13, 15, 18, 20: Xaa = Ile, Val, Leu
  VARIANT 29: Xaa = Asp or Glu
  VARIANT 46, 47, 48, 65, 84: Xaa = His, Ser, Gly, Thr, Ala, Arg, Lys, Glu, Gln, Asp, Asn
  VARIANT 90: Xaa = Ser or Thr

SEQ ID NO: 225 - protein, 75 aa, Hordeum vulgare
MAISSKIAVVFMLLLSTTFMQLPVPADARRLEVKAPILSVHRPCTGRSTLETPPEQVESTTPGHSPSIGHNSPPN

SEQ ID NO: 226 - protein, 75 aa, Triticum aestivum
MAISSNTVVVFMLLLSTAFMQLPVPADARRLEVKAPIISVRPPCTGRSTLEAPAEQVESTTPGHSPSIGHNSPPN

SEQ ID NO: 227 - protein, 75 aa, Triticum aestivum
MAISSNTVVVFMLLLSTAFMQLPVPADARRLEVKAPIISVRPPCTGRGTLEAPAEQVESTTPGHSPSIGHNSPPN

SEQ ID NO: 228 - protein, 75 aa, Triticum aestivum
MAISSNTVVVFMLLLSTAFMQLPVPADARRLEVKAPIVSVRPPCTGRSTLGAPAEQVESTTPGHSPSIGHNSPPN

SEQ ID NO: 229 - protein, 129 aa, Zea mays
MQAAYIKRRELAQEVRQSQLCEPARVINLSTTEFSPPPLPSHSKLEIMAISSKTVAVSMLLLSAVFFVLLSAPAHARKLGTMRAPTSSVRRPPAAPCTPRSILQEVATQTESTTTPGHSPSIGHNSPPN

SEQ ID NO: 230 - protein, 129 aa, Artificial Sequence
  Consensus Sequence
  VARIANT 1, 2, 3, 4, 5, 6, 7, 8, 9, 10, 11, 12, 13, 14, 15, 16, 17, 18, 19,20, 21, 22, 23, 24, 25, 26, 27, 28, 29, 30, 31, 32, 33, 34, 35, 36, 37,38, 39, 40, 41, 42, 43, 44, 45, 46, 47, 58, 66, 69, 80, 87, 91, 92, 93,94, 95, 101, 113: Xaa = Any Amino Acid
  VARIANT 53, 81, 108: Xaa = Ser, Thr, Tyr, His, Arg, Lys, Asp, Asn, Glu, Gln
  VARIANT 54, 68, 82, 86, 102: Xaa = Ala, Ile, Val, Leu, Trp, Phe, Met, Cys, Pro
  VARIANT 55, 56, 64, 65, 71, 72, 99, 106, 107, 110: Xaa = Gly, Ala, Val, Ser, Thr, Cys
  VARIANT 75: Xaa = His, Arg, Lys, Asp, Glu
  VARIANT 78, 83, 90: Xaa = His, Arg, Lys
  VARIANT 104, 105: Xaa = His, Ser, Gly, Thr, Ala, Arg, Lys, Glu, Gln, Asp, Asn
  VARIANT 101: Xaa = Ala, Val, Leu, Ala, Trp, Phe, Gly, Met, Cys, Ser, Thr, Tyr, Asn, Gln
XXXXXXXXXXXXXXXXXXXXXXXXXXXXXXXXXXXXXXXXXXXXXXXMAISSXXXXVXMLLLSXXXFXXLXXPAXARXLXXXXAPXXSVXXXXXXPCTXRXXLXXXXXQXESXTTPGHSPSIGHNSPPN

SEQ ID NO: 231 - protein, 129 aa, Artificial Sequence; identical to SEQ ID NO: 230
  Consensus Sequence
  VARIANT 53, 81, 108: Xaa = Ser, Thr, Tyr, His, Arg, Lys, Asp, Asn, Glu, Gln
  VARIANT 54, 68, 82, 86, 102: Xaa = Ala, Ile, Val, Leu, Trp, Phe, Met, Cys, Pro
  VARIANT 55, 56, 64, 65, 71, 72, 99, 106, 107: Xaa = Gly, Ala, Val, Ser, Thr, Cys
  VARIANT 75: Xaa = His, Arg, Lys, Asp, Glu
  VARIANT 78, 83, 90: Xaa = His, Arg, Lys
  VARIANT 101: Xaa = Ala, Val, Leu, Ala, Trp, Phe, Gly, Met, Cys, Ser, Thr, Tyr, Asn, Gln
  VARIANT 104, 105: Xaa = His, Ser, Gly, Thr, Ala, Arg, Lys, Glu, Gln, Asp, Asn
  VARIANT 1, 2, 3, 4, 5, 6, 7, 8, 9, 10, 11, 12, 13, 14, 15, 16, 17, 18, 19,20, 21, 22, 23, 24, 25, 26, 27, 28, 29, 30, 31, 32, 33, 34, 35, 36, 37,38, 39, 40, 41, 42, 43, 44, 45, 46, 47, 58, 66, 69, 80, 87, 91, 92, 93,94, 95, 110, 113: Xaa = Any Amino Acid

SEQ ID NO: 232 - protein, 129 aa, Artificial Sequence
  Consensus Sequence
  VARIANT 53, 104: Xaa = Ser, Thr, Tyr, His, Arg, Lys, Asp, Asn, Glu, Gln
  VARIANT 65, 105: Xaa = Gly, Ala, Val, Ser, Thr, Cys
  VARIANT 87: Xaa = Ile, Val, Leu
  VARIANT 1, 2, 3, 4, 5, 6, 7, 8, 9, 10, 11, 12, 13, 14, 15, 16, 17, 18, 19,20, 21, 22, 23, 24, 25, 26, 27, 28, 29, 30, 31, 32, 33, 34, 35, 36, 37,38, 39, 40, 41, 42, 43, 44, 45, 46, 47, 66, 80, 91, 92, 93, 94, 95, 113: Xaa = Any Amino Acid
XXXXXXXXXXXXXXXXXXXXXXXXXXXXXXXXXXXXXXXXXXXXXXXMAISSXTVVVFMLLLSTXXFMQLPVPADARRLXEVKAPIXSVRXXXXXPCTGRSTLXXPAEQVESXTTPGHSPSIGHNSPPN

SEQ ID NO: 233 - protein, 129 aa, Artificial Sequence; identical to SEQ ID NO: 232
  Consensus Sequence
  VARIANT 53, 104: Xaa = Ser, Thr, Tyr, His, Arg, Lys, Asp, Asn, Glu, Gln
  VARIANT 65, 105: Xaa = Gly, Ala, Val, Ser, Thr, Cys
  VARIANT 87: Xaa = Ile, Val, Leu
  VARIANT 1, 2, 3, 4, 5, 6, 7, 8, 9, 10, 11, 12, 13, 14, 15, 16, 17, 18, 19,20, 21, 22, 23, 24, 25, 26, 27, 28, 29, 30, 31, 32, 33, 34, 35, 36, 37,38, 39, 40, 41, 42, 43, 44, 45, 46, 47, 66, 80, 91, 92, 93, 94, 95, 113: Xaa = Any Amino Acid

SEQ ID NO: 234 - protein, 99 aa, Hordeum vulgare
MASSKVLCTCILIIVVSSSQAEARRLTTARVAAVASKGKEPWGALESNSRSFRATSTETSVAGAAGLDGEAMSTATTVESRGTAPGNSPGIGNKGKINN

SEQ ID NO: 235 - protein, 99 aa, Triticum aestivum
MARSKVLCTCILIIIISSIQAEARRLTTATVVAVASKGKEPWGELEGNSRSLRATSSETSIAGAQGLDGEAMSTATTVESRGTAPGNSPGIGNKGKINN

SEQ ID NO: 236 - protein, 106 aa, Oryza sativa; identical to SEQ ID NO: 211

SEQ ID NO: 237 - protein, 102 aa, Zea mays; identical to SEQ ID NO: 212

SEQ ID NO: 238 - protein, 117 aa, Artificial Sequence
  Consensus Sequence
  VARIANT 3, 61, 69, 73, 74, 81: Xaa = His, Ser, Gly, Thr, Ala, Arg, Lys, Glu, Gln, Asp, Asn
  VARIANT 4, 5, 23, 40, 42, 54, 60: Xaa = Ser, Thr, Tyr, His, Arg, Lys, Asp, Asn, Glu, Gln
  VARIANT 8, 50, 51, 65, 78: Xaa = Ala, Ile, Val, Leu, Trp, Phe, Met, Cys, Pro
  VARIANT 10, 37, 38, 39, 49, 66, 75, 79, 96, 100: Xaa = Gly, Ala, Val, Ser, Thr, Cys
  VARIANT 17, 18, 19, 53: Xaa = Ile, Val, Leu
  VARIANT 25, 97: Xaa = Asp or Glu
  VARIANT 64: Xaa = His, Arg, Lys, Asp, Glu
  VARIANT 68, 70, 71: Xaa = Ser or Thr
  VARIANT 55, 67, 82: Xaa = Ala, Val, Leu, Ala, Trp, Phe, Gly, Met, Cys, Ser, Thr, Tyr, Asn, Gln
  VARIANT 6, 14, 15, 20, 22, 30, 31, 32, 33, 34, 35, 44, 45, 46, 47, 48, 52,56, 57, 58, 59, 62, 63, 72, 76, 83, 84, 85, 86, 87, 88, 89, 90, 91, 92,93: Xaa = Any Amino Acid
MAXXXXVXCXCILXXIXXXXSXXAXARRLXXXXXXAXXXXGXEXXXXXXXXXXXXXXXXXXXXXXXXXXXXXXXXXGXXGXXXXXXXXXXXXXTTXXSRXTAPGNSPGIGNKGKINN

SEQ ID NO: 239 - protein, 117 aa, Artificial Sequence; identical to SEQ ID NO: 238
  Consensus Sequence
  VARIANT 3, 61, 69, 73, 74, 81: Xaa = His, Ser, Gly, Thr, Ala, Arg, Lys, Glu, Gln, Asp, Asn
  VARIANT 4, 5, 23, 40, 42, 54, 60: Xaa = Ser, Thr, Tyr, His, Arg, Lys, Asp, Asn, Glu, Gln
  VARIANT 8, 50, 51, 65, 78: Xaa = Ala, Ile, Val, Leu, Trp, Phe, Met, Cys, Pro
  VARIANT 10, 37, 38, 39, 49, 66, 75, 79, 96, 100: Xaa = Gly, Ala, Val, Ser, Thr, Cys
  VARIANT 17, 18, 19, 53: Xaa = Ile, Val, Leu
  VARIANT 25, 97: Xaa = Asp or Glu
  VARIANT 55, 67, 82: Xaa = Ala, Val, Leu, Ala, Trp, Phe, Gly, Met, Cys, Ser, Thr, Tyr, Asn, Gln
  VARIANT 64: Xaa = His, Arg, Lys, Asp, Glu
  VARIANT 68, 70, 71: Xaa = Ser or Thr
  VARIANT 6, 14, 15, 20, 22, 30, 31, 32, 33, 34, 35, 44, 45, 46, 47, 48, 52,56, 57, 58, 59, 62, 63, 72, 76, 83, 84, 85, 86, 87, 88, 89, 90, 91, 92,93: Xaa = Any Amino Acid

SEQ ID NO: 240 - protein, 117 aa, Artificial Sequence; identical to SEQ ID NO: 238
  Consensus Sequence
  VARIANT 3, 61, 69, 73, 74, 81: Xaa = His, Ser, Gly, Thr, Ala, Arg, Lys, Glu, Gln, Asp, Asn
  VARIANT 4, 5, 23, 40, 42, 54, 60: Xaa = Ser, Thr, Tyr, His, Arg, Lys, Asp, Asn, Glu, Gln
  VARIANT 8, 50, 51, 65, 78: Xaa = Ala, Ile, Val, Leu, Trp, Phe, Met, Cys, Pro
  VARIANT 10, 37, 38, 39, 49, 66, 75, 79, 96, 100: Xaa = Gly, Ala, Val, Ser, Thr, Cys
  VARIANT 17, 18, 19, 53: Xaa = Ile, Val, Leu
  VARIANT 25, 97: Xaa = Asp or Glu
  VARIANT 55, 67, 82: Xaa = Ala, Val, Leu, Ala, Trp, Phe, Gly, Met, Cys, Ser, Thr, Tyr, Asn, Gln
  VARIANT 64: Xaa = His, Arg, Lys, Asp, Glu
  VARIANT 68, 70, 71: Xaa = Ser or Thr
  VARIANT 6, 14, 15, 20, 22, 30, 31, 32, 33, 34, 35, 44, 45, 46, 47, 48, 52,56, 57, 58, 59, 62, 63, 72, 76, 83, 84, 85, 86, 87, 88, 89, 90, 91, 92,93: Xaa = Any Amino Acid

SEQ ID NO: 241 - protein, 117 aa, Artificial Sequence
  Consensus Sequence
  VARIANT 3, 22, 39, 74, 82, 84: Xaa = Ala, Val, Leu, Ala, Trp, Phe, Gly, Met, Cys, Ser, Thr, Tyr, Asn, Gln
  VARIANT 8, 17, 18, 53: Xaa = Ile, Val, Leu
  VARIANT 30, 37, 38, 49, 51, 56, 62, 65, 66, 72, 76, 79, 96, 100: Xaa = Gly, Ala, Val, Ser, Thr, Cys
  VARIANT 40, 42: Xaa = Ser, Thr, Tyr, His, Arg, Lys, Asp, Asn, Glu, Gln
  VARIANT 50, 83: Xaa = Ala, Ile, Val, Leu, Trp, Phe, Met, Cys, Pro
  VARIANT 52, 61, 69, 73: Xaa = His, Ser, Gly, Thr, Ala, Arg, Lys, Glu, Gln, Asp, Asn
  VARIANT 64: Xaa = His, Arg, Lys
  VARIANT 78: Xaa = Ser or Thr
  VARIANT 97: Xaa = Asp or Glu
  VARIANT 4, 5, 6, 10, 14, 15, 19, 20, 23, 25, 31, 32, 33, 34, 35, 44, 45,46, 47, 48, 54, 55, 57, 58, 59, 60, 63, 67, 68, 70, 71, 75, 87, 88,89, 90, 91, 92, 93: Xaa = Any Amino Acid
MAXXXXVXCXCILXXIXXXXSXXAXARRLXXXXXXAXXXXGXEXXXXXXXXXXXXXXXXXXXXXXXXXXXXXXXXXGXXGEXXXTAXXXXXXXTTXXSRXTAPGNSPGIGNKGKINN

What is claimed is:

1. A method of cultivating a genetically altered plant with increased mycorrhization and/or promoted symbiotic responses under conditions comprising a phosphate level around the plant roots that suppresses mycorrhization and/or symbiotic responses, comprising:

a) providing the genetically altered plant,
  wherein the plant or a part thereof comprises one or more genetic alterations that result in increased activity of a NODULATION SIGNALING PATHWAY 1 (NSP1) protein, a NODULATION SIGNALING PATHWAY 2 (NSP2) protein, or both a NSP1 protein and a NSP2 protein as compared to an activity of a NSP1 protein or a NSP2 protein in a wild type (WT) plant grown under the same conditions, and
  wherein the one or more genetic alterations reduce the phosphate level suppression of mycorrhization and/or symbiotic responses; and
b) cultivating the genetically altered plant under the phosphate level around the plant roots,
  wherein the genetically altered plant has increased mycorrhization and/or promoted symbiotic responses as compared to the WT plant grown under the same conditions.

2. The method of claim 1, wherein the phosphate level around the plant roots completely suppresses mycorrhization and/or symbiotic responses in the WT plant grown under the same conditions, and wherein a nitrogen level around the plant roots is permissive of mycorrhization and/or symbiotic responses in the WT plant grown under the same conditions.

3. The method of claim 1, wherein the mycorrhization comprises a symbiotic association of one or more plant parts selected from the group consisting of a root system, a root, a root primordia, a root tip, a lateral root, a root meristem, and a root cell, with mycorrhizal fungi; and wherein mycorrhizal fungi are selected from the group consisting of Acaulosporaceae spp., Diversisporaceae spp., Gigasporaceae spp., Pacisporaceae spp., *Funneliformis* spp., *Glomus* spp., *Rhizophagus* spp., *Sclerocystis* spp., *Septoglomus* spp., *Claroideoglomus* spp., *Ambispora* spp., *Archaeospora* spp., *Geosiphon pyriformis, Paraglomus* spp., other species in the division Glomeromycota, and any combination thereof.

4. The method of claim 1, wherein the increased mycorrhization enhances plant uptake of nutrients surrounding the plant roots selected from the group consisting of phosphate, nitrate, and potassium, and wherein the increased mycorrhization optionally enhances plant uptake of water.

5. The method of claim 1, further comprising cultivating the genetically altered plant under conditions comprising a nitrogen level around the plant roots that suppresses mycorrhization and/or symbiotic responses, wherein the genetically altered plant of step (a) further comprises one or more genetic alterations that result in increased activity of a C-TERMINALLY ENCODED PEPTIDE (CEP peptide) as compared to an activity of a CEP peptide in a WT plant grown under the same conditions and that reduce the nitrogen level suppression of mycorrhization and/or symbiotic responses, and wherein step (b) further comprises cultivating the genetically altered plant under the nitrogen level around the plant roots, wherein the genetically altered plant has increased mycorrhization and/or promoted symbiotic responses as compared to the WT plant grown under the same conditions.

6. The method of claim 1, further comprising cultivating the genetically altered plant under conditions comprising a nitrogen level around the plant roots that suppresses mycorrhization and/or symbiotic responses, wherein step (b) further comprises exposing the plant or a part thereof to an effective amount of a CEP peptide, wherein the effective amount of the CEP peptide increases mycorrhization and/or promotes symbiotic responses in the plant or plant part as compared to the WT plant grown under the same conditions without the CEP peptide.

7. The method of claim 5, wherein the nitrogen level around the plant roots completely suppresses mycorrhization and/or symbiotic responses in the WT plant grown under the same conditions.

8. The method of claim 1, wherein providing the genetically altered plant comprises the steps of:

a) transforming a plant cell, tissue, or other explant with a vector comprising a first nucleic acid sequence encoding a NSP1 protein or a NSP2 protein operably linked to a second nucleic acid sequence encoding a promoter;
b) selecting successful transformation events by means of a selection agent, marker-assisted selection, or selective media;
c) regenerating the transformed cell, tissue, or other explant into a genetically altered plantlet; and
d) growing the genetically altered plantlet into a genetically altered plant with increased activity of the NSP1 protein or the NSP2 protein as compared to an untransformed WT plant.

9. The method of claim 1, wherein providing the genetically altered plant comprises the steps of:

a) transforming a plant cell, tissue, or other explant with one or more gene editing components that target a nuclear genome sequence operably linked to an endogenous NSP1 protein or an endogenous NSP2 protein;
b) selecting successful transformation events by means of a screening technology, an enriching technology, a selection agent, marker-assisted selection, or selective media;
c) regenerating the transformed cell, tissue, or other explant into a genetically altered plantlet; and
d) growing the genetically altered plantlet into a genetically altered plant with overexpression of the NSP1 protein or the NSP2 protein as compared to an untransformed WT plant.

* * * * *